United States Patent 11,098,302 (IDENTIFICATION OF POLYNUCLEOTIDES ASSOCIATED WITH A SAMPLE) - sequence listing, part 142

SEQ ID NO: 528172 - DNA, 505 bp, Homo sapiens
  misc_feature: HEFZJCU01B5UBA.48.53.E09.1.454.heavy.3.raw
agtatacatacacgaccggtgctcgatttagagagagtgtgttgggtttgggggctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtaggcagtagtcccatatactacgcagactctgtgaagggccgattcatcaatctccagagacaatgccgagaactcactgtttctgcaaatgaacagcctgagagacgaggacacggctgtttattactgtgcgagagtgcggatttcacctacacta

SEQ ID NO: 528173 - DNA, 503 bp, Homo sapiens
  misc_feature: HEFZJCU01DQA2E.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgacgaaagtatttactatagaggtgacgtac

SEQ ID NO: 528174 - DNA, 500 bp, Homo sapiens; identical to SEQ ID NO: 463101
  misc_feature: HEFZJCU01BENT9.10.38.D05.1.454.heavy.3.raw

SEQ ID NO: 528175 - DNA, 518 bp, Homo sapiens
  misc_feature: HEFZJCU01BYSZ1.51.15.B04.1.454.heavy.3.raw
cgatcgtatacacgaccggtgctcgatttagacagtatatatccgcggggaggtctcagagaggagccttagccctggactccaaggcctttccacttggtgatcagcactgagcacagaggactcaccatggagttggggctgagctgggttttccttgttgctattttagaaggtgtccaatgtgaggtgcacctggtggagtctgggggaggcttggtccagccggggggggtccctgagactctcctgtagagcctctggattcacctttagtaacttctggatgagctgggtccgccaggctccagggaaggggctggagtgggtggccaacataaacaaagataggaggtgagaagtactatgtggactctgtgaagggccgattcaccgtctccagagacaacgccaagaactcactgtatctgcaaatgaacagcctgagaaccagggacacggccctgtattactgtgcgagacacgggtacaaacaactttggttacggaaagactcc

SEQ ID NO: 528176 - DNA, 505 bp, Homo sapiens
  misc_feature: HEFZJCU01BUS6H.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgagcctacggcagcggcctttgactttctc

SEQ ID NO: 528177 - DNA, 540 bp, Homo sapiens
  misc_feature: HEFZJCU01DSN14.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtgggtggtaccacatactacacagactccgtgaagggccgattcaccatctcagaagacaattccaggaacacattgtatcttcaaatgaataacctgagagccgaggacacggccatgtattactgtgtggggcattttacttgacccctgggggcccggggaacccgtggtcaccgtccttcccccacccctccaacccg

SEQ ID NO: 528178 - DNA, 524 bp, Homo sapiens
  misc_feature: HEFZJCU01EEST3.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacacaaactccgtgaggggccgcttcatcatctccagagacaattcccagaacatactgtctctgcaactcaataacctgagaggcgaggacacggccgtatatcactgtgccaaagatcagaaggacggttcggggagttacaaatattactacttctactatggaatggacgtctgggccgaggaccacggtcaccgtctcctcagcctccaccaaggcccatcggtcttccccctggccaccctcctccaagacgcacctctgggggcacagcggccctgggctgcctggtcaaggactactccagacgtatcac

SEQ ID NO: 528179 - DNA, 533 bp, Homo sapiens
  misc_feature: HEFZJCU01BJG1X.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggtcgaactcctatgcttttgatatctggggccaagggacaatggtcaccgtctcttcagcctccaccaacgggcccatcggtccttcccccgtcggccaccctcctccaacgagccacctcgtcggggggccacacggccggtcccc

SEQ ID NO: 528180 - DNA, 495 bp, Homo sapiens
  misc_feature: HEFZJCU01C0KOS.4.75.G09.1.454.heavy.3.raw
  modified_base (425)..(425): a, c, t, g, unknown or other
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaagggccctggagtggcttgcactcatttattgggatgatgataagcgctacagcccatctctgatgaacaggctcaccatcaccaaggacgcctaccaaaaccaggtggtccttacaatgaccaacatggaccctgtggacacagccacatattactgtgcacaganatacgggcagcacgtggttggggctactggggccagggaaccctggtcaccgtctcctcagcctccaccg

SEQ ID NO: 528181 - DNA, 551 bp, Homo sapiens
  misc_feature: HEFZJCU01CP1LV.2.11.A11.1.454.heavy.3.raw
  modified_base (538)..(538): a, c, t, g, unknown or other
acgctcgacacacgaccggtgctcgatttagctacgactgcagggtgtacacctgtggttctcggggctgccctttggctttggagatggtttttctcgatggggggctgggagggctttgttggagaccttgcacttgtactccttgccattcagccagtcctggtgcaggacggtgaggacgctgaccacacggtacgtgctgttgtactgctcctcccgcggtttctttgtcttggcattatgcacctccacgccgtccacgtaccagttgaacttgacctcagggtcttcgtggctcacgtccaccaccacgcatgtgacctcaggggtccgggagatcatgagggtgtccgttgggttttggggcctcgggggctacgtggggccagggaaccatggtcaccgtctcctcagcctcccaccaacgggcccatcggtccttccccctggccacccctcctcccaagagcacctcgtgggggcacagcggccctgggctgccgtggtcaaggactacttcctgtcgagcgtctgngcggcgtgcgacg

SEQ ID NO: 528182 - DNA, 510 bp, Homo sapiens
  misc_feature: HEFZJCU01A9IAF.9.12.B01.1.454.heavy.3.raw
tgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaagggctggagtgggtctcagttatttagtagcggtggtaacacatactacgcagactccgtgaagggcagattcaccatctccagagacaattccaggaacacgctgtatcttcaatagaacagcctgagagtcgaggacgacggctgtatattactgtgcgagagatgtgtacgtctttgatatcgtggggccaaggggac

SEQ ID NO: 528183 - DNA, 486 bp, Homo sapiens
  misc_feature: HEFZJCU01A59VA.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgacaaatgaacagcctgagagctagaggacacggctgtgtattactgtgcgaggcggt

SEQ ID NO: 528184 - DNA, 500 bp, Homo sapiens
  misc_feature: HEFZJCU01D6W0P.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagatgttttctgtcatcgtacaatttgataggctctatggactggacttcgt

SEQ ID NO: 528185 - DNA, 414 bp, Homo sapiens; identical to SEQ ID NO: 453362
  misc_feature: HEFZJCU01AYV10.40.81.H04.1.454.heavy.3.raw

SEQ ID NO: 528186 - DNA, 521 bp, Homo sapiens
  misc_feature: HEFZJCU01BLD3V.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccggtgacgccgtacggcagccggtccttttgactttcgtgggggcctagggggaccg

SEQ ID NO: 528187 - DNA, 480 bp, Homo sapiens; identical to SEQ ID NO: 446171
  misc_feature: HEFZJCU01E1MJO.22.36.D03.1.454.heavy.3.raw

SEQ ID NO: 528188 - DNA, 530 bp, Homo sapiens
  misc_feature: HEFZJCU01ER6ZP.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccagggaacccgtggtcaccgtctcctcacgcctccaccg

SEQ ID NO: 528189 - DNA, 525 bp, Homo sapiens
  misc_feature: HEFZJCU01EZHS1.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattaactgtgcgagagatggggcccacggaacgttacctacgctatggacgtctggggccgaagggacccg

SEQ ID NO: 528190 - DNA, 535 bp, Homo sapiens
  misc_feature: HEFZJCU01ASSLI.7.78.H01.1.454.heavy.3.raw
  modified_base (522)..(522): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggggtccgacaggcccctggacaaggccttggactacatgggatggatcaacaccgacactgggaaccccacctatgcccaggccttcacagggcggtttgtcttctccatggatacctctgtcgggacggcgttatcttgcagataaccaaccttcaacctgacgacactgccgtttattttgtacgagagcgtcgtctgtcagtggaattgactactggggccagggaaccctggtcaccgtctcctcanctcccaccacggg

SEQ ID NO: 528191 - DNA, 512 bp, Homo sapiens
  misc_feature: HEFZJCU01CSK9Z.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgtcgagcggacccggggctccctcaatggctttcatttacgg

SEQ ID NO: 528192 - DNA, 509 bp, Homo sapiens
  misc_feature: HEFZJCU01DILK5.51.81.H04.1.454.heavy.3.raw
cgatcgtatacacgaccggtgctcgatttagtagtgtagattcgcggggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcaggggtcatcatgaccggggacgacgtccatcgccacaacttacatggaactgaccagtctgacattgacgacacggccgtcgtattactgtgcgacagagcgcggacagaggttcgctactggttcgaggctctccccacg

SEQ ID NO: 528193 - DNA, 553 bp, Homo sapiens
  misc_feature: HEFZJCU01ENW6L.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggctagtttacttgacccccgttggggggcccgggggtaaccctggggtccacccggtcctcccccaaccccttcccaacccg

SEQ ID NO: 528194 - DNA, 484 bp, Homo sapiens
  misc_feature: HEFZJCU01D9RC6.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagccacctccgagagcacagcggccctgggctgcctggtcaaggactacttcccactactatg

SEQ ID NO: 528195 - DNA, 535 bp, Homo sapiens
  misc_feature: HEFZJCU01DY849.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatgggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgctgtcagtggaattgactactggggccgagggaaccctggtacaccgtctcctccagcctccaccgaacgg

SEQ ID NO: 528196 - DNA, 504 bp, Homo sapiens
  misc_feature: HEFZJCU01B4NH1.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagtctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacaagggcagagtcaccattaccagggacacaatccgcgaacacagcctacatggagctgagcagcctgacatctgaagacacggctgtgtattactgtttcgagacggggctaggtctggggatctagtttataggttgactcgtcgttct

SEQ ID NO: 528197 - DNA, 436 bp, Homo sapiens; identical to SEQ ID NO: 470400
  misc_feature: HEFZJCU01D9133.40.27.C05.1.454.heavy.3.raw

SEQ ID NO: 528198 - DNA, 516 bp, Homo sapiens
  misc_feature: HEFZJCU01CW54L.7.71.G05.1.454.heavy.3.raw
  modified_base (405)..(405): a, c, t, g, unknown or other
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagngacattccaggaacacaatgtatttggaaatgaacagcctaagtcctgaggacacgggtgtatactactgtacgaaggaggggggaccgagcgggagtccagtacttaccg

SEQ ID NO: 528199 - DNA, 502 bp, Homo sapiens
  misc_feature: HEFZJCU01EZ47Q.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagctgacagtcgacgacacggccatgtatttttgtgtcgagcgacccgggggctcctcaatggctttc

SEQ ID NO: 528200 - DNA, 527 bp, Homo sapiens
  misc_feature: HEFZJCU01B2W00.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactacgtggggccagggaccctggtcaccgtctcctcagcctccacc

SEQ ID NO: 528201 - DNA, 516 bp, Homo sapiens
  misc_feature: HEFZJCU01BUQVB.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtagcgaagagaccgctacgtgggggcccggagcccgtggtccg

SEQ ID NO: 528202 - DNA, 512 bp, Homo sapiens
  misc_feature: HEFZJCU01ETS26.22.36.D03.1.454.heavy.3.raw
acatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccggcttcatcatctccagagacgattaccgaaacaacagtgaatctgcaaatgtacagcctcagcgccgaggacacggccgtctacttctgtgcgaaagacctctatttttgggccgcggccgtacg

SEQ ID NO: 528203 - DNA, 523 bp, Homo sapiens
  misc_feature: HEFZJCU01ERAFY.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacaacggccgtctacttattgtgtcatagacctaaggatacaacgacggtggtaccgtggtacttc

SEQ ID NO: 528204 - DNA, 534 bp, Homo sapiens
  misc_feature: HEFZJCU01D7BLS.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttcgtacccctgggggccggggaaccctggtcaccgtctccccaccctccaacccg

SEQ ID NO: 528205 - DNA, 481 bp, Homo sapiens
  misc_feature: HEFZJCU01B1F7E.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactcaagaacactctgtttctccaaatgaacagcctgagaggcgaggacacggcagtgtattactgtgcgagagatcgaca

SEQ ID NO: 528206 - DNA, 505 bp, Homo sapiens
  misc_feature: HEFZJCU01CVKYT.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttgcgattatggcatgacctgggtccgccaagctccagggaagggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtattggacgtctggggccaagggaccacggtcatcgtctcctcagcctccaccaaggcccatcggtcttcccctggcacccctcctccaagagcacctctgggggcacagcggccctgggctgcctggtcaaggactacttcctacgtcgtat

SEQ ID NO: 528207 - DNA, 487 bp, Homo sapiens
  misc_feature: HEFZJCU01AZPPA.40.71.G05.1.454.heavy.3.raw
tctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatccaccagccacagcctatagtgggaggtgaggagcctgacatctggacgacacggcctatattactgtgcgagagatcatcggaggtggaatggccgtgt

SEQ ID NO: 528208 - DNA, 508 bp, Homo sapiens
  misc_feature: HEFZJCU01B45WV.12.78.H01.1.454.heavy.3.raw
atacgacgtacacgaccggtgctcgatttagtgtgagtagtttgggtttggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 528209 - DNA, 510 bp, Homo sapiens
  misc_feature: HEFZJCU01EA4BG.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccagacgggagttccaagtactcttt

SEQ ID NO: 528210 - DNA, 483 bp, Homo sapiens
  misc_feature: HEFZJCU01ANYEH.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttccccctggcgccctgctccaggagcacctccgagagcacagccggccctggggctgcctggtcaaggactacttcccacgagagta

SEQ ID NO: 528211 - DNA, 484 bp, Homo sapiens
  misc_feature: HEFZJCU01AV893.52.19.B08.1.454.heavy.3.raw
cgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactcgtgaagggccgattcatcatctccagagacaactccgagaacacgctgtatctgcaaatgatcaggctgagagctgaagacacggctttatattactgtgcgaacttaatcacggac

SEQ ID NO: 528212 - DNA, 531 bp, Homo sapiens
  misc_feature: HEFZJCU01DQHKK.40.81.H04.1.454.heavy.3.raw
tctagcgactcacgaccggtgctcgatttagtagtgtagattcgcgggggtgccctgagagaatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatcgtgaggcgggactggtaacctcgtcgacgacgtacggcctatgtattactggttggaacgtaggtacgttgggtcggtccgtaaccggccggggggacttggacccg

SEQ ID NO: 528213 - DNA, 507 bp, Homo sapiens
  misc_feature: HEFZJCU01E0EWY.52.86.H09.1.454.heavy.3.raw
cgcagtacgacacgaccggtgctcgatttagtgctatagacttgggtttggggctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgtttgctacc

SEQ ID NO: 528214 - DNA, 492 bp, Homo sapiens
  misc_feature: HEFZJCU01EWLUO.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaacgggcccatcggtcttcccctggcgccctgctccaggagcacctccgagagcacagcggcccgtgggctgcctggtcaggactacttcccacgagagta

SEQ ID NO: 528215 - DNA, 512 bp, Homo sapiens; identical to SEQ ID NO: 450914
  misc_feature: HEFZJCU01DLP9C.15.67.G01.1.454.heavy.3.raw

SEQ ID NO: 528216 - DNA, 516 bp, Homo sapiens
  misc_feature: HEFZJCU01D3YX0.10.85.H08.1.454.heavy.3.raw
  modified_base (478)..(478): a, c, t, g, unknown or other
  modified_base (484)..(484): a, c, t, g, unknown or other
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggagatggaagtgagaactactttgtgggctctgtggaagggccgattcaccatctccagagacaacgccaagaagtcactgtatctgcaaatgaacgatgtgagagtcgaggacacggctgtatatttctgtgcgaggggngccggntatggttcggacctcgtgggccgagggtaccg

SEQ ID NO: 528217 - DNA, 519 bp, Homo sapiens
  misc_feature: HEFZJCU01BQONS.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagcccacatattactgttcacgctctatggttcggggagttattagtccctactttgactactggggccagggactctggtcaccgtctccgcagcctccacctaagggcccagtcc

SEQ ID NO: 528218 - DNA, 499 bp, Homo sapiens
  misc_feature: HEFZJCU01B4IMF.48.71.G05.1.454.heavy.3.raw
agtatacatacacgaccggtgctcgatttagtgtcgtcgcaagagagagggggggcatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccaggcctgaagtctcgaagacacgggcatatatttctgtgccgacagactggtcgtggactttctcgtctgcttagt

SEQ ID NO: 528219 - DNA, 513 bp, Homo sapiens
  misc_feature: HEFZJCU01B3FT2.17.34.D01.1.454.heavy.3.raw
  modified_base (500)..(500): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgagacacggcttctacttctgtgcgaggagtaatactatacactgctcttttacacctcctgacttcnggcatgacccgtc

SEQ ID NO: 528220 - DNA, 482 bp, Homo sapiens
  misc_feature: HEFZJCU01DOKWN.49.28.C06.1.454.heavy.3.raw
agtcgagagacacgaccggtgctcgatttagagctcacgtattgggtttggggtgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagtaagaagtactatgcagactccgtgaagggccgattcaccatctccagagacaatccaagaacacgctatatttgcacatgaacagcctgagagctgaggacacggctatttattactgtgcgaactttaa

SEQ ID NO: 528221 - DNA, 509 bp, Homo sapiens
  misc_feature: HEFZJCU01CVW8T.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtcccacgagaaccagactatttggagtttgagcagcctgagatctgacgacacggccgttttattactgtgcgcggagataatagtcaacacgtagaacgggcgtttttgggggtggttc

SEQ ID NO: 528222 - DNA, 529 bp, Homo sapiens
  misc_feature: HEFZJCU01D8IR2.7.78.H01.1.454.heavy.3.raw
  modified_base (406)..(406): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggcccttcacagggcggtttgtcttctccatggatacctctgtcgggacggcttanctgcagataaccaacctttcaacctgacgacactgccgtttattttgtacgagagcgtcgtctgtcagtggaattgactacgtgggccagggaaccctggtcaccgtctcctcagcctccacc

SEQ ID NO: 528223 - DNA, 534 bp, Homo sapiens
  misc_feature: HEFZJCU01BAZ1U.51.15.B04.1.454.heavy.3.raw
cgatcgtatacacgaccggtgctcgatttagacagtatatatccgcggggaggtctcagagaggagccttagccctggactccaaggcctttccacttggtgatcagcactgagcacagaggactcaccatggagttggggctgagctgggttttccttgttgctattttagaaggtgtccaatgtgaggtgcacctggtggagtctgggggaggcttggtccagccgggggggtccctgagactctcctgtagagcctctggattcacctttagtaacttctggatgagctgggtccgccaggctccagggaaggggctggagtgggtggccaacataaacaaagatggaggtgagaagtactatgtggactctgtgaagggccgattcaccgtctccagagacaacgccaagaactcactgtatctgcaaatgaacagcctgagaaccagggacaccggccctgtattactgtgcgagacacgggtcaaaacaactttggtcgggaagactcctggggccgaggggaccctc

SEQ ID NO: 528224 - DNA, 507 bp, Homo sapiens
  misc_feature: HEFZJCU01C1PFG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctaacatggagttgaggagcctgcatctgacgacacggccgtctattactgtgcgagagtcccacgatccgggtgagtcctacggcaggcggccctttgacttctc

SEQ ID NO: 528225 - DNA, 496 bp, Homo sapiens
  misc_feature: HEFZJCU01ECB0M.40.81.H04.1.454.heavy.3.raw
tctagcgactcacgaccggtgctcgatttagtagtgtagattcgcggggacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtgggatcaaccctaccagaggtggcacaaagtatcgacagaactttcagggcagggtcaccatgacctgggacgcgtccatcagcacagtctacatggatctgagcgggactggacctcgtgacgacgacggcatgtattactgtggaagagacgttggtggctaccggcggggctgaccacgtgggc

SEQ ID NO: 528226 - DNA, 520 bp, Homo sapiens
  misc_feature: HEFZJCU01AXYJ5.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttaatttctgtgcgaaggaggcatatgggaagtacgattttcgatccctccgcagtcgacactttgattactggggccggggaaccctggtcgccgtctcctcagcctccaccaagggcccatcggtccttcccctggcaccctcctccaagagcacctctgggggcacagcggccctgggctgcctggtcaaggactacttccagacgtatca

SEQ ID NO: 528227 - DNA, 508 bp, Homo sapiens
  misc_feature: HEFZJCU01C7SZA.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgtcaaaagactaccaaccccttacgttacg

SEQ ID NO: 528228 - DNA, 503 bp, Homo sapiens
  misc_feature: HEFZJCU01BATY1.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacgagtatgcaaccgaagatgaagggcagagtcacgattaccgacggaccacccccacgaacacagtctacatgcaactgacgagcctgagagctgacgacacggccgtctatttactgtgcgagaatgttttctgtcatcgtacaatctgatggctctatggactggacttc

SEQ ID NO: 528229 - DNA, 518 bp, Homo sapiens
  misc_feature: HEFZJCU01BNAN7.4.57.F02.1.454.heavy.3.raw
agcactgtagcacgaccggtgctcgatttagctcgatatagttgggtttgggggggaagaggaagactgacggtcctcccaggtgtccagtgtcaggtgcacctggtggagtcggggggaggcgtggtccagcctggggggtccctgagactctccgtgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtctttgaccagtggggccagggaaccctggtcaccgtctcctcagcttccaccaagggcccatcggtcttcccctcggcgccctcgctccgacgagcacctcgtggggcgcagccg

SEQ ID NO: 528230 - DNA, 531 bp, Homo sapiens
  misc_feature: HEFZJCU01AEE3Z.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttaggactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacacgcgtgtattaactgtaccacactccctgaaagcgtcaactactactactacggtatggacctc

SEQ ID NO: 528231 - DNA, 510 bp, Homo sapiens
  misc_feature: HEFZJCU01B65WY.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctcgctccaggacgcacctccgagagcacagcggcc

SEQ ID NO: 528232 - DNA, 502 bp, Homo sapiens
  misc_feature: HEFZJCU01DHLKN.14.55.E11.1.454.heavy.3.raw
  modified_base (426)..(426): a, c, t, g, unknown or other
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctggggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgnaaatgaatagcctgagagccgaggacgacggcttcgtgtatttactgttgtcagaggatgggagggggtgggtaga

SEQ ID NO: 528233 - DNA, 532 bp, Homo sapiens
  misc_feature: HEFZJCU01COION.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtagttaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactcccctgaagcgtcaactactactactggtatgacctcgtgggccaaac

SEQ ID NO: 528234 - DNA, 538 bp, Homo sapiens
  misc_feature: HEFZJCU01AI2RT.4.66.F11.1.454.heavy.3.raw
  modified_base (437)..(437): a, c, t, g, unknown or other
agcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagatgattcaaaaagtacactgtatctggaaatgaacancctgagaatcgacgacacagtccgtttattactgcagaagaggcactatcggtcccgtggggccagggaacccttggtaccaccggtctccctcacgtccc

SEQ ID NO: 528235 - DNA, 517 bp, Homo sapiens
  misc_feature: HEFZJCU01EFZ7N.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagcgacgacacggccatttattactgcgcgaaggatagtacgggtcgacaacgggtggctacggcgtttactacg

SEQ ID NO: 528236 - DNA, 517 bp, Homo sapiens
  misc_feature: HEFZJCU01BTKIY.7.71.G05.1.454.heavy.3.raw
  modified_base (302)..(302): a, c, t, g, unknown or other
  modified_base (357)..(357): a, c, t, g, unknown or other
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccnccaagctccaggcaagggattggagtgggtggcagttgttcatctgagggcagtnttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagttccaagtacttccg

SEQ ID NO: 528237 - DNA, 496 bp, Homo sapiens
  misc_feature: HEFZJCU01ANU4A.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaagggctggagtgggttcatacatttctagtaattctggtaccatacactatgcagtctctgtgaagggccgattcaccatctccagagacacgccaggactcacttatctgcaaatgagcagcctgagagtcgaggacgacgggtattattactgtgcgagagatagtctgtctatgcttccgggagctaa

SEQ ID NO: 528238 - DNA, 512 bp, Homo sapiens
  misc_feature: HEFZJCU01BJLR5.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctggggggaggcttggcacagcctggggggtccctgagactctcctgtgcagcctctggattcacctttgacagctatgccatgacctgggtccgccaggctccaggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtccacccatactactttgactacgtggggccg

SEQ ID NO: 528239 - DNA, 480 bp, Homo sapiens
  misc_feature: HEFZJCU01EL2MR.48.56.F01.1.454.heavy.3.raw
agtatacatacacgaccggtgctcgatttagcagacgtctgaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcaggggtcaccatgaccagggacacgtccatcagcacagcctacatggaattgagcaggctgacatctgacgacgacggcccgtgtatttattgtgcgagagcctcacg

SEQ ID NO: 528240 - DNA, 507 bp, Homo sapiens
  misc_feature: HEFZJCU01BL000.13.37.D04.1.454.heavy.3.raw
  modified_base (421)..(421): a, c, t, g, unknown or other
  modified_base (454)..(454): a, c, t, g, unknown or other
  modified_base (506)..(506): a, c, t, g, unknown or other
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctgggggggtccctgagactctcgtgtgcagcctctggatttagttttagcagttatgccatgagctgggtccgccaggctccagggaagggctggagtgggtttcgggtattagtgctcttgatgatagcacatactatgcagactccgttaagggccgcttcaccatctccagagacaattccaagaacncgctatatctgcagatgaacagccttggggacnccgaggacacggccgtttatcactgtgcgaaagatattgtaatgatgggtanc

SEQ ID NO: 528241 - DNA, 482 bp, Homo sapiens
  misc_feature: HEFZJCU01C06XR.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgcaagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaaggactgctggggccagggagcccttgtcaccgtctcctcagcctccaccaagggcccatcggtcttcccctggcgccctgctccaggagcacctccgagagcacagcggccctgggctgcctggtcaaggactactccctactactatg

SEQ ID NO: 528242 - DNA, 500 bp, Homo sapiens
  misc_feature: HEFZJCU01EAQU6.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgtacgttttgagttggt

SEQ ID NO: 528243 - DNA, 529 bp, Homo sapiens
  misc_feature: HEFZJCU01BJ1OJ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctaactggccaatactatgggggcttgttctggggccaggggaccctggtcatcgtctccccagcctccaccaagggcccatcggtcttccccctggccgcctcg

SEQ ID NO: 528244 - DNA, 529 bp, Homo sapiens
  misc_feature: HEFZJCU01BTKGO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaaccctactggccaatactatgggggcttgttctggggccaggggaccctggtcatcgtctccccagcctccaccaacgggcccatccgggtctttcccccgtggccg

SEQ ID NO: 528245 - DNA, 504 bp, Homo sapiens
  misc_feature: HEFZJCU01CJ2WJ.5.6.A06.1.454.heavy.3.raw
atcagacacgcacgaccggtgctcgatttagatctactgacaggggtctcagagaggtgccttagccctggattccaaggcatttccacttggtgatcagcactgaacacagaggactcaccatggagttggggctgcgctggggttttccttgttgctattttagaaggtgtccagtgtgaggtgcagctggtggagtctgggggaaagttggtgcaggcctggggagtccctgagactctcctgtgaaggcgctggatttaccctcagttcctataaatgggctgggtccgccaggctccagggaagggctggagtggctttcaatcatctacagtagtgggagtgtcatttattacgcggactctgtgaagggccgattcaccatttccagagacaacgccaagaactcactgtatctgcaaatgaacagcctgagagcgaggacacggctgtatattactgtgcgagagatcgtggggccaacagtggcctactttgtac

SEQ ID NO: 528246 - DNA, 517 bp, Homo sapiens
  misc_feature: HEFZJCU01AE1LB.53.33.C11.1.454.heavy.3.raw
cgcgtatacacacgaccggtgctcgatttagagtgagctcgttgggtttggggctctgggagaggagcccagcactagaagtcggcggtgtttccattcggtgatcagcactggaacacagaggactcaccatggagtttgggctgagctgggttttcctcgttgcttttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtagaagggccgattcaccatctccagagacaattccaagaatacgctgtatctgcacatgaacagcctgagagccgaagacacgggtgtttattactgtgcgaacttaattacggaggacaacggtaacccccgtccgc

SEQ ID NO: 528247 - DNA, 515 bp, Homo sapiens
  misc_feature: HEFZJCU01CQTRQ.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccattactactgtgcggcggggaggtggacggagcttcggttttcggagtttatcatctactacttttagtaacg

SEQ ID NO: 528248 - DNA, 510 bp, Homo sapiens
  misc_feature: HEFZJCU01DY5UX.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaaggccctggagtggcttgcgctcatttattgggatgagagtaagcactacagtccgtctctgaagaacaggctcaccatcaccaaggacacctccacaaaccaggtggtccttacaatgaaccaatatggaccctgtggacacagccacatattactgttcacgctctatggtcggggagttattagtccctatttgactactgggccagggactctgtcacgtctccgcagcctccaccaacgggccc

SEQ ID NO: 528249 - DNA, 544 bp, Homo sapiens
  misc_feature: HEFZJCU01DCJCA.4.59.F04.1.454.heavy.3.raw
agcactgtagcacgaccggtgctcgatttagtacacacacttagggattggggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttcgtgtgcgagatctttcgatttttggagtggtaaccccttggctactgggggccaacggggtaaccctgggtccaccgtctcctttcagtccctccaccaagggcccacg

SEQ ID NO: 528250 - DNA, 397 bp, Homo sapiens; identical to SEQ ID NO: 448710
  misc_feature: HEFZJCU01AQU3H.7.60.F05.1.454.heavy.3.raw

SEQ ID NO: 528251 - DNA, 393 bp, Homo sapiens
  misc_feature: HEFZJCU01AJT0A.49.46.E02.1.454.heavy.3.raw
agtcgagagacacgaccggtgctcgatttagactcatctacagggaaaggggcttgagtggattggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaaggggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 528252 - DNA, 502 bp, Homo sapiens
  misc_feature: HEFZJCU01A85Y6.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacaggggtcaccatgaccacggacacgtccatcaacacagcctacatggaactgaggagcctaagatctgacgacacggccgtttattattgtgcaataagaattgacaaacgatgctttgatatgtgggcaagggacacg

SEQ ID NO: 528253 - DNA, 532 bp, Homo sapiens
  misc_feature: HEFZJCU01BOHBA.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatagggggcgttgttctgggggccgagggggaccctggtcatcgtctccccagcctccaccaagggcccatcggtcttcccctggtcgcctcg

SEQ ID NO: 528254 - DNA, 506 bp, Homo sapiens
  misc_feature: HEFZJCU01DPK49.17.25.C03.1.454.heavy.3.raw
  modified_base (446)..(446): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccttccgggacagacttaccatcgaccacgaactcctccataaacacagcctacatggagttgaggagcctgacatctgacgacacggccgtntattactgtgcgagagtcccacgatccggtgagcctacggcagcggcctttgacttcgtc

SEQ ID NO: 528255 - DNA, 387 bp, Homo sapiens
  misc_feature: HEFZJCU01C5KJR.11.27.C05.1.454.heavy.3.raw
cgagagataccacgaccggtgctcgatttagacgcgatcgaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgatgcttttgatttctgggccaagggacaatgctcaccgtctcttcagcctccaccaagggcccatcggtcttccccctggcaccctcctccaagagcacctctgggggctacagcggccctgggctgcctggtcaaggactacttccgtatctctcg

SEQ ID NO: 528256 - DNA, 522 bp, Homo sapiens
  misc_feature: HEFZJCU01DU7DV.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggagggctggagtgggtggccaacatagagtacgatgggaagtgagaaaactatgtggactccgtgaagggccgattcaccatctccagagacaacgacaagaatttagtgtatctgcaaatgagcagcctgagagccgaaggaccacgggctggtgtattattgtgcgag

SEQ ID NO: 528257 - DNA, 517 bp, Homo sapiens
  misc_feature: HEFZJCU01B3PRN.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaggctggagtggcttggccgtattagaaccaaacctgacaagtacgcgacaatttatgctgcgtcggtgcaaggcaggttcaccatctccagagatgattcagagaacacggcgtatctgcaatgaacagcctgaaaccgaggacacggccgtgtattactgtgccagacatccgtcgtattacgtatttttctagtggtcccg

SEQ ID NO: 528258 - DNA, 485 bp, Homo sapiens
  misc_feature: HEFZJCU01DOK0T.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggccaccctcctccaagagcacctctgggggcacagcggccctggggctcgcctggtcaaggactacttcctagagacacg

SEQ ID NO: 528259 - DNA, 509 bp, Homo sapiens
  misc_feature: HEFZJCU01EX5N5.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcagtcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggaccacccccacgaacacagtctacatgcaactgacgagcctgagagctgacgacacgggccgtctattactgtgcgagaattgttttctgtcatcgtacaatttgataggtctctatcggactggtacttcgtc

SEQ ID NO: 528260 - DNA, 530 bp, Homo sapiens
  misc_feature: HEFZJCU01D2H0E.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtccaccgtctcctcagcctccaccaa

SEQ ID NO: 528261 - DNA, 515 bp, Homo sapiens
  misc_feature: HEFZJCU01DIDY4.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgttgcgagagccctcggcagaagtctggactactactattatggtatgg

SEQ ID NO: 528262 - DNA, 517 bp, Homo sapiens
  misc_feature: HEFZJCU01AGKIJ.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcaggactcaccatgaccacagacacatcagcgaacacagtcaacatggagttgcggagcctgcgatctgacgacgcggccgtatattactgtgcgagagtacgtagcggctcgtcctttgactacgtgggctgggactctggtccaccgtctcccg

SEQ ID NO: 528263 - DNA, 513 bp, Homo sapiens
  misc_feature: HEFZJCU01AKRDP.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattactccctgaagctgagctctgtgaccgccgcacgacacggctgtctattactgtgcgaggccccgagccgcagtggtcttttgtatgtcctttgatatgtggggccgaaggggacaagtggttaccg

SEQ ID NO: 528264 - DNA, 515 bp, Homo sapiens
  misc_feature: HEFZJCU01BJ7SU.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtcccggtcaggacagcctatatggaggtgaccagcctgagccctgacgacacggccatatattttctgtgcgcggaggaatttccgacttcgtggaataatttacttggggttaggtaaactaccttt

SEQ ID NO: 528265 - DNA, 533 bp, Homo sapiens
  misc_feature: HEFZJCU01DWT7F.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgactctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaacgggcccatcggtcttcccctggcgccctgctccaggagcacctccgagagcacagccggccctcgggctcgcctggtcaaggactacttcctaacg

SEQ ID NO: 528266 - DNA, 508 bp, Homo sapiens
  misc_feature: HEFZJCU01DZ1DM.49.5.A05.1.454.heavy.3.raw
agtcgagagacacgaccggtgctcgatttagatagatagacaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaaatactacgcagactccgtgaagggccgattcaccatctcccgacacaattccaagaacacattgtttctactgctgaacagcctgagaagtgacgacacggctgtatatcactgtgcggcaggcaacgattactaccgaaggtactactggggccac

SEQ ID NO: 528267 - DNA, 517 bp, Homo sapiens
  misc_feature: HEFZJCU01B3PKA.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctgggccagggaacctggtcaccgtctcctcagcctccaccaagggcccatcggtcttccccctcggcaccctcctccaagagcacctctgggggcacagcggccctgggctgcctgtcaaggactactccgagtagtacacg

SEQ ID NO: 528268 - DNA, 522 bp, Homo sapiens; identical to SEQ ID NO: 457538
  misc_feature: HEFZJCU01EVAFD.3.82.H05.1.454.heavy.3.raw

SEQ ID NO: 528269 - DNA, 506 bp, Homo sapiens
  misc_feature: HEFZJCU01EXN2F.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtccttcccctggcaccctcctccaagagcacctctgggggcacagcggcctgggctgcctggtcaaggactacttccgagtagtaca

SEQ ID NO: 528270 - DNA, 520 bp, Homo sapiens
  misc_feature: HEFZJCU01C9CJ3.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactcgtggggccagggaccctggtcaccgtctcctcagcctccaccaaggg

SEQ ID NO: 528271 - DNA, 559 bp, Homo sapiens
  misc_feature: HEFZJCU01DOCVY.52.14.B03.1.454.heavy.3.raw
  modified_base (293)..(293): a, c, t, g, unknown or other
cgcagtacgacacgaccggtgctcgatttagtgtgagtagttcccgggggggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcactgtctctggtggctccatcagcagtagtgattactactggggctggatccgccagcccccagggaaggggctggagtggattgggagtggtctttttanagtggaaacacctactacaacccgtccctcaagagtcgagtcacccatatcagtagacacgtccaagagccagttctccctgaagctgacgtctctgacgccgcggacacggccgtttattactgtgcgagtaccccggaaccttttacgatttttggagtggatactataccggtatgggggtccttttgtacttctggggccagggaaccctggtcaccgtctcctcacgcctccaccaacgggcccagtccgtcttccccctc

SEQ ID NO: 528272 - DNA, 516 bp, Homo sapiens
  misc_feature: HEFZJCU01E00TO.13.33.C11.1.454.heavy.3.raw
tcacgtactacacgaccggtgctcgatttagagtgagctcgttgggtttggggacccagcacccacatctgtcctctagagaatccccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaagggccttgagtgggatggggacatatcagccctgtcagtggtgccacaaagtttgcacagaactttcaggacagggtcaccatgaccacggacacgtccatcaacacagcctacatggaactgaggagacctaagatctgacgacacggccgtttattattgtgcaaataagaattgcaaacgatagtcttttgatatggttggggccgaaggggactacg

SEQ ID NO: 528273 - DNA, 526 bp, Homo sapiens
  misc_feature: HEFZJCU01CA3KE.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagctgagaaccgaggacacgagccgtgtattactgtaccacactccctgaaagcgtacaactactactactacggtatggacctc

SEQ ID NO: 528274 - DNA, 504 bp, Homo sapiens
  misc_feature: HEFZJCU01BO578.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtcccgccaggctccaggcgaggggctgggagtgggtggcgattatatcacatgatggaactaatagacgctatgccgactccgtgaagggccgattcaccatctccagagacaattccaagaacacgcagtatctgcaaatgaacagcctgagagctagaggacacggctggtgtattactggtagggagaggatgggaggtcggatagttgta

SEQ ID NO: 528275 - DNA, 520 bp, Homo sapiens
  misc_feature: HEFZJCU01AUEVL.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtgcagttgtttcatctgagggcagtgttcaatggtatgcagactccgtgaagggccgattcaccatctccagagacaattccaggaacacaatgtatttggaaatgaacagacctaagtcctgaggacacgggtgtatactactgtacgaagggagggggaaccgaggcgggagttccaagtacttccg

SEQ ID NO: 528276 - DNA, 512 bp, Homo sapiens
  misc_feature: HEFZJCU01DFK7Q.48.74.G08.1.454.heavy.3.raw
agtatacatacacgaccggtgctcgatttagtagctctatcaggggaggtctgggagaggagccccagccctgagattcccaggtgtttccattcagtgatcagcactgaacacagaggactcaccatggagttgggactgagctggattttccttttggctcttttaacaggtgtccagtgtgaagtgcagctggtggagtctgggggaggcttggtacagccccggcaggtccctgagactctcctgtgcagcctctggattcatctttggtgattatgccatgcactgggtccggcgaattccagggaagggcctggagtgggtctcaggtattagttgggatggtgacagtataggctatgcggactctgtgaggggccgattcaccatcaccagggaaaacgccaataactccctgtgtctacaaatgaacaatctgagacctgaagacacggccttgtatttttgtgtaaaagatattctccgacaattatggtcagtcgtggggt

SEQ ID NO: 528277 - DNA, 543 bp, Homo sapiens
  misc_feature: HEFZJCU01B5TKA.17.34.D01.1.454.heavy.3.raw
cgtagactagcacgaccggtgctcgatttagatcgtctgtgtttggggtttgggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgacagcctgtcatctgagacacgggcttctacttctgtgcgaggagtaattactataacactgctcctttttacacctcccgtttcgtactttctgggggtcctaagtcggtaaaccccggttccg

SEQ ID NO: 528278 - DNA, 518 bp, Homo sapiens
  misc_feature: HEFZJCU01A86RE.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactacgtgggccgagggaaccctggtccaccgtctcctc

SEQ ID NO: 528279 - DNA, 395 bp, Homo sapiens; identical to SEQ ID NO: 444517
  misc_feature: HEFZJCU01DYJGF.16.68.G02.1.454.heavy.3.raw

SEQ ID NO: 528280 - DNA, 506 bp, Homo sapiens
  misc_feature: HEFZJCU01ARGXE.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaagggacactgtcaccgtctcttcagcctccaccaagggcccatcggtcttccccctggcgccctgctccaggacg

SEQ ID NO: 528281 - DNA, 421 bp, Homo sapiens
  misc_feature: HEFZJCU01AJA3X.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaaggcccatcggtcttccccctggcaccctcctccaagagcacctctgggggcacagcggccctgggctgcctggtcaaggactacttccgagtagtaca

SEQ ID NO: 528282 - DNA, 502 bp, Homo sapiens
  misc_feature: HEFZJCU01ELQZ1.17.10.A10.1.454.heavy.3.raw
  modified_base (485)..(485): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacgggccgtctattactgtgcgagaatgttttctgtcatcgtacaatttgataggctntatggactggacttgtc

SEQ ID NO: 528283 - DNA, 509 bp, Homo sapiens
  misc_feature: HEFZJCU01B8KGT.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcgttagttcagcctggggagtcccgtgagactctcctgtgtagtctctggaatcagtttcagtaccttctggatgcactgggtctgccaaactccaggtaagggctggtgtgggtctcacgtatcaatcctgatggcagtggtataaattatgcggactccgtgaggggccgattcagcatctccagagacaacggcaagagtatactgtatctagaatgaacaatctgagagtcgacgatacggctgtctatcattgtgttttcgatcgtcttcggtccgcgggtacttcgtgggccgacc

SEQ ID NO: 528284 - DNA, 524 bp, Homo sapiens
  misc_feature: HEFZJCU01BMRXK.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggcctttcacagggcggtttgtcttctccatggatacctctgtcgggacggcttatctgcagataaccaacctttcaacctgacgacactgccgtttattttgtacgagagcgtcgtctgtcagtgaattgactactggggccagggaaccctggtcaccgtctcctcagcctcc

SEQ ID NO: 528285 - DNA, 489 bp, Homo sapiens
  misc_feature: HEFZJCU01B6YL9.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctcaccaagggcccatcggtcttcccctggcaccctcctccaagagcacctctgggggcacagcggccctgggctgcctggtcaaggctacttccgagtgcgtct

SEQ ID NO: 528286 - DNA, 511 bp, Homo sapiens
  misc_feature: HEFZJCU01BCDCH.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacaagcctacatggagctgagcagcctgacatctgaagacacggctgtgtattactgttcgagacgggctaggtctggggatctagttaattagtgactcgtcgtttctcgggggaccg

SEQ ID NO: 528287 - DNA, 521 bp, Homo sapiens
  misc_feature: HEFZJCU01BUL3A.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggcctaagggacaagggtcaccgtctccgcagcctccaccg

SEQ ID NO: 528288 - DNA, 517 bp, Homo sapiens
  misc_feature: HEFZJCU01CVAOC.3.6.A06.1.454.heavy.3.raw
agacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttactactactggagttggatccggcagtccccagggaagggactagagtgggttggccatatgcatcacagtgggagcaccaactacaacccctccctcgagagtcgagtcaccatatcaatagacacgtccaagaaccagttctccctgagcttgaagtctgtcaatgctgcggacacggccgtttattactgtgcgagtactgcggggaaagatccatttgatagtttggggccaaggaacaatggtcaccgtctcttcagcctccaccaaggg

SEQ ID NO: 528289 - DNA, 503 bp, Homo sapiens
  misc_feature: HEFZJCU01BR77O.17.10.A10.1.454.heavy.3.raw
cgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggcttgacggtaaggcacagtatgcaccgaagatgaagggcagagtcacgattaccacggaccacccccacgaacacagtctacatgcaactgacggagcctgagagctgacgacacggccgtctattactgtgcgagaatgttttctgtcatcgtacaatttgataggctctatggactggtacttcgtc

SEQ ID NO: 528290 - DNA, 535 bp, Homo sapiens
  misc_feature: HEFZJCU01DQ9TK.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattcctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctcccagcctccaccaagggcccatccggtcttcccctgggcgccctgcctccaggagcaaccctccgaggacggccacaggccggcccgttgggggcctggcccttgggtccaaaggggaccttaactttaccctacttatc

SEQ ID NO: 528291 - DNA, 509 bp, Homo sapiens
  misc_feature: HEFZJCU01AI32C.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactcccctgtgcagcctctggaatcactttcagtgacgcctggatgaactgggtccgccaggctccagggaagggctggagtggattggccgtattaaaagtgagcctgatggtgggacaacagactacgctgcacccgtgaagggcagattcaccatctccagagatgattcaaggaacacagtgtttctgcaaatgaacagcctgactgccgggggacactgcgtgtattactgtgccagcagcagtacctaggcctactattaattttttgtacg

SEQ ID NO: 528292 - DNA, 539 bp, Homo sapiens
  misc_feature: HEFZJCU01EKHMO.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtccttccccctcgggcgccctcgcctccacggacgccgaccctcccgagagccaccgaggccggccccgtcggggccgtc

SEQ ID NO: 528293 - DNA, 516 bp, Homo sapiens
  misc_feature: HEFZJCU01E1E86.26.12.B01.1.454.heavy.3.raw
  modified_base (470)..(470): a, c, t, g, unknown or other
  modified_base (487)..(487): a, c, t, g, unknown or other
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaacctccctctatctaagaaatggacagtctgacactgagacacggtccttttattctgtncgaaaggtggaaccganattattcacaagctggcactggtacttcg

SEQ ID NO: 528294 - DNA, 517 bp, Homo sapiens
  misc_feature: HEFZJCU01EACFI.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcaccctactacaacccgtccctcaaaagtcgaggcaccatatccgtagacacgtccaagaaccaattctccctgaagctgagctctgtgaccgcccgcagacacggctgtctattactgtgcgaggccccgagcgcagtggctttttgtatgtcctttgtatattggtgggggccgaaaggggtacaaacgtggtccg

SEQ ID NO: 528295 - DNA, 507 bp, Homo sapiens; identical to SEQ ID NO: 462344
  misc_feature: HEFZJCU01ELPFI.53.34.D01.1.454.heavy.3.raw

SEQ ID NO: 528296 - DNA, 510 bp, Homo sapiens
  misc_feature: HEFZJCU01EFCJX.48.82.H05.1.454.heavy.3.raw
  modified_base (479)..(479): a, c, t, g, unknown or other
agtatacatacacgaccggtgctcgatttagtcgagctctctcgcgggcacgaccggtgctcgatttagacgcgatcgaagggtttggggtctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtggaggggccgagttcgccttctccagagacaattccaagagcacggttcatctgcaaatgagcgcccngacgacctgacgacacggctgtctatttacg

SEQ ID NO: 528297 - DNA, 499 bp, Homo sapiens
  misc_feature: HEFZJCU01EVGOI.51.28.C06.1.454.heavy.3.raw
cgatcgtatacacgaccggtgctcgatttagagctcacgtattgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacagcctacatggaactgaggagcctgggatctgacgacacggccgtgtattactgtgcgagagataggccccaggggagaggtagtggttttcgtaccgctgg

SEQ ID NO: 528298 - DNA, 527 bp, Homo sapiens
  misc_feature: HEFZJCU01CXRBY.3.82.H05.1.454.heavy.3.raw
agacgcactccacgaccggtgctcgatttagtcgagctctctcgcgggggggagaggagcccagcttttactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgaggtggttcggggacctcacctggttctacttcgatctctgggccgt

SEQ ID NO: 528299 - DNA, 506 bp, Homo sapiens
  misc_feature: HEFZJCU01BV55A.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattccaccatcctccagagacaattccaagaacacgctgtttcttcaaatgaacagcctgagagccgatgacacggccgtgtattactgtgcgagagatggggcccacgaacgttacgtacgctatggacgtc

SEQ ID NO: 528300 - DNA, 522 bp, Homo sapiens
  misc_feature: HEFZJCU01AWLYU.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaataacctgagaggcgaggacacggccatttatttctgtgcgaaggaggcatatgggaagtacgattttcgatccctccgcagtcgacacttttgattactggggccggggaacccgtggtcgccgtctcctcagcctccaccaagggcccatcggtcttcccctggcaccctcctccaagagcacctctgggggcacagcggccctgggctgcctggtcgaaggactacttccagacgtatca

SEQ ID NO: 528301 - DNA, 541 bp, Homo sapiens
  misc_feature: HEFZJCU01A2UB2.52.55.E11.1.454.heavy.3.raw
  modified_base (467)..(467): a, c, t, g, unknown or other
cgcagtacgacacgaccggtgctcgatttagcactcgcacgttgggtttggggacataacaaccagattcctcctctaaagaagcccctgggagcacagctcatcaccatggactggacctggaggttcctctttgtggtggctgcagttacagctgtccagtcccaggtccacctggtgcagtctggggctgaagtaaagaagcctgggtcgtcggtgaaggtctcctgcagggcctctggagccaccttcggcacttatgggatcagctgggtgcgccaggcccctggacaagggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgttttacctgtgcgaggatttaanagtctcgcccacaaccttctggtcggcggcgggtcgtttccaccctttacttacttttacgaccttcctggggg

SEQ ID NO: 528302 - DNA, 508 bp, Homo sapiens
  misc_feature: HEFZJCU01AK2B8.17.33.C11.1.454.heavy.3.raw
  modified_base (439)..(439): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccgttacaatgaccaatatggaccctgtggacacagccacatattactgttcacgctctatggttcgggngttattgtccctactttgactactggggccagggactctggtcacgtctcgcagcctcaccaagggccc

SEQ ID NO: 528303 - DNA, 534 bp, Homo sapiens
  misc_feature: HEFZJCU01B9ZI2.48.40.D07.1.454.heavy.3.raw
agtatacatacacgaccggtgctcgatttagtgatagagcgtaacaacagaggggcccagacctgggattcccagctgtttctgcttgctgatcaggaccgcacacagagagctcaccatggagttggggctgacctgggttttccttgtggctactttaagaggtgtcctgtgtgaggtgcacctgctggagtccggggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccggcttcaccgtctccagagacaacggcgagaatactctgtatttgcagatgagaaatctgagaggcgaggacaccgcgctttattattgtacaacgtcgttttacttttctaatggtggcttcttacgaacgacatgactatggggtcggggaacctgg

SEQ ID NO: 528304 - DNA, 561 bp, Homo sapiens
  misc_feature: HEFZJCU01BTBFK.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagagtcgagtaacgatctcagtggacacgtctaacaatcacctctccctgaggctgagctctgtgacagccgcggacacggggcgtttattactgtggtcgaaggaggggacggactaacgggtgaaccgtacgttgggggttccgaaccccgttgggggcccacggggaaccctcgggtaccacccggtcttccttcaggtccctccgaaacccg

SEQ ID NO: 528305 - DNA, 526 bp, Homo sapiens
  misc_feature: HEFZJCU01BITFV.3.26.C04.1.454.heavy.3.raw
agacgcactccacgaccggtgctcgatttagtctagcgactttgggtttgggctgacctgggttttcctcgttgctcttttaagaggtgtccagtgtcaggtgcagctggtggagtctgggggaggcgtggtccagcctgggaggtccctgagactctcctgtgcagcctctgaattcaccttcagtaattatgctatgcactgggtccgccaggctccgggcaaggggccggagtgggtggcagttatatcttatgatggaaagagtgagtactacgcagactccgtgcagggccgatttatcatctccagagacagtctcaagaacaccctatatctgcaaatgaacagcctgagacctgaggacacggctctatattactgtgcgagagaggcgtcgggaccgatagccgtggcgtgggacttttgactactgggggccagggaaccctggtcaccgatctcctcagcctccaccaagggcccatccggtcttcccccgtggccaccctccctccaagacgcc

SEQ ID NO: 528306 - DNA, 527 bp, Homo sapiens
  misc_feature: HEFZJCU01CT440.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcgggggcccacggaacgttactacgctagtggacgtcgtcggggccgaacgggaccg

SEQ ID NO: 528307 - DNA, 505 bp, Homo sapiens
  misc_feature: HEFZJCU01DH5DK.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgcaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtgtagtttactggttgggagaggatagggaggtcggattaagtttgta

SEQ ID NO: 528308 - DNA, 511 bp, Homo sapiens
  misc_feature: HEFZJCU01AYH0X.10.38.D05.1.454.heavy.3.raw
  modified_base (481)..(481): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagtttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgctacaatctgacgagtcgaacgacacggccacctattattgtgcgcgacangactacgctacaattctggggccagggacg

SEQ ID NO: 528309 - DNA, 466 bp, Homo sapiens; identical to SEQ ID NO: 445374
  misc_feature: HEFZJCU01ALV74.16.78.H01.1.454.heavy.3.raw

SEQ ID NO: 528310 - DNA, 496 bp, Homo sapiens
  misc_feature: HEFZJCU01AS9NF.14.25.C03.1.454.heavy.3.raw
  modified_base (461)..(461): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctggtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtntattactgtgggagagatggaggtcgatattgtta

SEQ ID NO: 528311 - DNA, 506 bp, Homo sapiens
  misc_feature: HEFZJCU01BNTB8.7.85.H08.1.454.heavy.3.raw
cgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaaagtaggaccataacttacacagactctgtgaagggccgattcaccacctccagagacgacgccaagaactcactgtctctgcaaatgaacagcctgagagtcgaggacacggctgtgtattactgtgcggagaggatcccgggaggggacggtatgacc

SEQ ID NO: 528312 - DNA, 478 bp, Homo sapiens
  misc_feature: HEFZJCU01CTCT1.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcgagggcgagggtcaccatgaccgagggacgaccgtccatcagcacgtccatcagcacagcctacatggacctgagcggcctgacatctgacgacaccggccgtatatttctgt

SEQ ID NO: 528313 - DNA, 538 bp, Homo sapiens
  misc_feature: HEFZJCU01DLSUT.52.49.E05.1.454.heavy.3.raw
  modified_base (293)..(293): a, c, t, g, unknown or other
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccgganaagggcttgagtggatgggatggatcagcggtgacaacggcaacacaaattatggacagaagttccagggcagagtcaccatgaccgcggacacatccacgaacacagcctacatggagctgagggagcctaagatctgacgacacggcgtttattactgtgtgagagatttagggacctcggcccgttgggggagttatcgttactttgacttactggggccaggggaacccaggtcaccgtct

SEQ ID NO: 528314 - DNA, 498 bp, Homo sapiens
  misc_feature: HEFZJCU01DN0EW.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaatttccagggacagagtcacgattaccgcggacgaatccacgaccacagcctacatagagctgcgcagcctgagatctgaagacacggccattttattactgtgcgagagatgcagggccctcccacagtcgttatttcttttgacctccgtggggccagggaaccctggtcaccgtctcctcg

SEQ ID NO: 528315 - DNA, 535 bp, Homo sapiens
  misc_feature: HEFZJCU01D0XQA.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaagatacgaagtctatgatacccaatttgggaggggtcctttcatgtctggggccaagggacgctggtcaccgtctcttcagcctccacaacgggcccatcgtcttccccgtggcaccctcctccaagagcacctctcgggggcacg

SEQ ID NO: 528316 - DNA, 534 bp, Homo sapiens
  misc_feature: HEFZJCU01B38BL.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactagctccttttacacctcccttgactttctggggccatcggaaccccggtcaccgtcc

SEQ ID NO: 528317 - DNA, 523 bp, Homo sapiens; identical to SEQ ID NO: 446270
  misc_feature: HEFZJCU01EF33C.12.40.D07.1.454.heavy.3.raw

SEQ ID NO: 528318 - DNA, 495 bp, Homo sapiens
  misc_feature: HEFZJCU01CSI7Z.14.25.C03.1.454.heavy.3.raw
cgtctagtaccacgaccggtgctcgatttagtagtgtagatttgggtttgggtgcccaagctgctggagggcacggtcaccacgctgctgagggagtagagtcctgaggactgtaggacagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagagtggaggtcgatattgtagtggtggtagctgctataactggatcgacccgtggggccagggaacccgtggtcaccgtctcctcagcctccaccaacgggcccagtcggtccttcccc

SEQ ID NO: 528319 - DNA, 511 bp, Homo sapiens
  misc_feature: HEFZJCU01AY8O9.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggaacctgaggagcctgagatttgacgacacggccatatattactgtgcgagagattgggccgacggaaccttgactactggggccagggaaccctggtcaccgt

SEQ ID NO: 528320 - DNA, 525 bp, Homo sapiens
  misc_feature: HEFZJCU01BMY79.18.33.C11.1.454.heavy.3.raw
  modified_base (435)..(435): a, c, t, g, unknown or other
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctccccaccctccaccaagggcccancggtcttcccctggccaccctcctccaacgagcacctctggggcacagcggccctggctgcctggtcaaggactacttcccatactcgta

SEQ ID NO: 528321 - DNA, 500 bp, Homo sapiens
  misc_feature: HEFZJCU01AIIHY.2.86.H09.1.454.heavy.3.raw
acgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcgggagcgaatgacttctggggccagggaaccctggtcaccgtctcctcagcctccaccaagggcccatcggtcttccccctggccgccctgctccaggagcacctccgagagcacaggcggccctgggctgcctggtcaaggactacttcctgtcgagcgt

SEQ ID NO: 528322 - DNA, 508 bp, Homo sapiens; identical to SEQ ID NO: 492372
  misc_feature: HEFZJCU01COJS4.3.17.B06.1.454.heavy.3.raw

SEQ ID NO: 528323 - DNA, 487 bp, Homo sapiens
  misc_feature: HEFZJCU01ELQF0.40.83.H06.1.454.heavy.3.raw
  modified_base (398)..(398): a, c, t, g, unknown or other
tctagcgactcacgaccggtgctcgatttagatcacgtgcgtcgcggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctggagggccgattcatcatctctagngacaattcgaagaacacggcttatctgcaaatgaaacagcctgacagtcggaaggacacggctgtatatttctgtgcgaatggaggtaa

SEQ ID NO: 528324 - DNA, 494 bp, Homo sapiens
  misc_feature: HEFZJCU01DAVBH.12.2.A02.1.454.heavy.3.raw
  modified_base (461)..(461): a, c, t, g, unknown or other
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagttcaccatgaccacagacacatccacgagcacagcctacatggagctgaggagcctgagatctgacgacacggccgtgtattactgtgcgagaggttttagngatacttatgtagtggtggtactgctacttttc

SEQ ID NO: 528325 - DNA, 513 bp, Homo sapiens
  misc_feature: HEFZJCU01B94CZ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagacaggctcaccatcaccaaggacacctccacaaaccaggtggtccttacaatgaccaatatggaccctgtggacacagccacatattactgttcacgctctatggttcgggagttattagtcctactttgactactgggccagggactctggtcaccgtctccgcagcctccaccaagggcccagtcc

SEQ ID NO: 528326 - DNA, 492 bp, Homo sapiens
  misc_feature: HEFZJCU01EY6FX.26.73.G07.1.454.heavy.3.raw
agactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcagtgacggtttcctgcagggcctctgggtacacgatcactacccatgctatcaactgggtgcgacaggcccctggacaaggacttgagtggttgggatggatcaacaccaacactgggcacccgacgtactctccaggacctcacaggacggcttgtcttttccgtggacacttctgtcagcacggcatatctgcagatcagcagtctaaagcctgaggacactgccgtgtattagttgtacgtagagaacgttatgccgtgtagtggtggtagttgctactttg

SEQ ID NO: 528327 - DNA, 526 bp, Homo sapiens
  misc_feature: HEFZJCU01DG5ZF.13.76.G10.1.454.heavy.3.raw
  modified_base (401)..(401): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaanaacacgctgtttctttcaaatgaacagcctgagagccgatgacacggccttgtattactgtgcgacgagagtggggcccaacgaacgtttactacgctattggacgtcgtggggccaagggaccg

SEQ ID NO: 528328 - DNA, 429 bp, Homo sapiens; identical to SEQ ID NO: 447944
  misc_feature: HEFZJCU01B3AEU.4.37.D04.1.454.heavy.3.raw

SEQ ID NO: 528329 - DNA, 394 bp, Homo sapiens
  misc_feature: HEFZJCU01AKUC1.16.24.C02.1.454.heavy.3.raw
tgtactactccacgaccggtgctcgatttagtacagatcgttagggaaaggggctggagtgggtctcaagtattagtggtgttggtggtctcacatattacgcagactccgtgaagtgccggttcaccgtctccagagacaattccaagaatacactgtatctgcgaatgaatggcctgagagccgaagacacggccgtctactactgtcgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacgttccgagtaggtaca

SEQ ID NO: 528330 - DNA, 510 bp, Homo sapiens
  misc_feature: HEFZJCU01EUA24.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccggggggtcccttagactctcctgtgcagcctctggcatcactttcagtgacgcctggatgagctgggtccgccaggctccagggaaggggctggagtgggttggccgtattaaagcgaggctgctggtgggacaacagactacgctgcacccgtgaagggcagattcaccatctccagagatgattccaaggagcacagtgtttctacaaatgaacagcctgactgccgggggacactgccgtgtattactgtgccaggcagcagcacctcggccactattatttcttttcg

SEQ ID NO: 528331 - DNA, 537 bp, Homo sapiens
  misc_feature: HEFZJCU01A3XEM.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtacttactgtgcgagatgtaggaaaagtatggctgtgttttagtggggcagggagccctggtctacccg

SEQ ID NO: 528332 - DNA, 510 bp, Homo sapiens
  misc_feature: HEFZJCU01D57QA.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgacaaatggacagcctgagagtcgaagacacggctgtgtattactgtgtgtctctgacgcctcggccggtacttggcttcgtggggtccg

SEQ ID NO: 528333 - DNA, 546 bp, Homo sapiens
  misc_feature: HEFZJCU01AZESR.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaatattcaccgagcttccagggcagaatgaccatctcccgggacacatccgcgagcgcaatctatctggaactgagccgcctgacatctgcagactcggcagtatatttctgtgtcgagaggagggggaggatgggttggaggggtaaatttggtttaattcccgaataccgttacttttggaaccctacgtcggggggcctaacgggggaaaccccg

SEQ ID NO: 528334 - DNA, 507 bp, Homo sapiens
  misc_feature: HEFZJCU01B6SJF.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagaccttaccatgaccacgaactcctccataaacacagcctacactggagttgaggagcctgacatctgacgacacggccgtctattactgtgcgagagtcccacgatccggtgacgcctacggcagcggcctttgaccttctc

SEQ ID NO: 528335 - DNA, 526 bp, Homo sapiens
  misc_feature: HEFZJCU01EQAWZ.13.65.F10.1.454.heavy.3.raw
tcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttgggggcgcggactcctcttgagatcgtggggccgagggggaccaagtggtcaccggtctcttcc

SEQ ID NO: 528336 - DNA, 503 bp, Homo sapiens
  misc_feature: HEFZJCU01B4CG4.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaaagaacacactgtatctggaaatgaccagcctgagaggggacgacgacgggtgtttattactgtgcgcgggataggaggctcatcgtggatacaactatt

SEQ ID NO: 528337 - DNA, 537 bp, Homo sapiens
  misc_feature: HEFZJCU01A6L7D.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagctcgtcatctgaggacgacgggcttctacttctgtgcgaggagtaattactaataacactcgcttccttttactacctcccttgtacttcgtgggccagtcggaacccggtaccg

SEQ ID NO: 528338 - DNA, 510 bp, Homo sapiens
  misc_feature: HEFZJCU01DXRPB.10.23.C01.1.454.heavy.3.raw
  modified_base (455)..(455): a, c, t, g, unknown or other
catagtagtgcacgaccggtgctcgatttagtacacgtgattagggattggggggggagaggagccccagccctgagattcccaggtgtttccattcagtgatcagcactgaacacagaggactcaccatggagttgggactgagctggattttccttttggctatttaaaaggtgttcagtgtgaagtgcagctggtggagtctgggggaggcttggtacagcctggcaggtccctgagactctcctgtgcagcctctggattcagctttgatgaatatgcatggactgggtccggcaagttccagggaagggcctggagtgggtctcaggtattgattggaatagtggtaccattgcctatgcggactctgtgaagggccgattcaccatcaccagagacgacgccaggagcctccctgtatctccaaatgaacagtctgagacctgaggacncggccttgtattactgtgtaagagggagtctagggtttcgaactatttagtagtt

SEQ ID NO: 528339 - DNA, 506 bp, Homo sapiens
  misc_feature: HEFZJCU01D6SZK.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacgttgggtttaggtaactacctt

SEQ ID NO: 528340 - DNA, 512 bp, Homo sapiens
  misc_feature: HEFZJCU01EQX1N.4.81.H04.1.454.heavy.3.raw
agcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagcctgagagtcgaggactcggctgtctactactgtgcgaggaagtaagggagctaccctacgtatttggacacg

SEQ ID NO: 528341 - DNA, 509 bp, Homo sapiens
  misc_feature: HEFZJCU01CYMYK.48.35.D02.1.454.heavy.3.raw
agtatacatacacgaccggtgctcgatttagcacacgatagttgggtttggggtctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccagactccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatagacacggctgtgtattattgtgtcgaaaaggggggagacgagctcgtccatcctacg

SEQ ID NO: 528342 - DNA, 523 bp, Homo sapiens
  misc_feature: HEFZJCU01BCU8I.3.82.H05.1.454.heavy.3.raw
  modified_base (493)..(493): a, c, t, g, unknown or other
  modified_base (513)..(513): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcnccctggtctacttcgatctntggggccgtc

SEQ ID NO: 528343 - DNA, 541 bp, Homo sapiens
  misc_feature: HEFZJCU01BSDUJ.13.35.D02.1.454.heavy.3.raw
  modified_base (430)..(430): a, c, t, g, unknown or other
  modified_base (475)..(475): a, c, t, g, unknown or other
  modified_base (503)..(503): a, c, t, g, unknown or other
tcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatntgcaaatgaacaacctgaaaagcgaggacacaggcgtgtattacngtaccacagatgggccagatgactaagngccgacgacgagttcgactacggcgggggaccggaacg

SEQ ID NO: 528344 - DNA, 539 bp, Homo sapiens
  misc_feature: HEFZJCU01B65I2.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctcgaggacactgccattattactgtgcgagagagggggagagtggagtagaacgtaatacgggaaaccgtttgacttttgggccagggaaccctggtcaccgtctcctcagcctccaccaacgggcccagtcggtcttccccctggccaccctcctcccaagagcacctcgtggggcacaggccggcccgtgggctgccgtc

SEQ ID NO: 528345 - DNA, 502 bp, Homo sapiens
  misc_feature: HEFZJCU01DP4VP.17.10.A10.1.454.heavy.3.raw
  modified_base (398)..(398): a, c, t, g, unknown or other
  modified_base (460)..(460): a, c, t, g, unknown or other
cgtagactagcacgaccggtgctcgatttagcgtcgatctcagggacccaaaaaccacacccctccttgggagaatcccctagatcacagctcctcaccatggactggacctggagcatcctttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccgacggacacccccacgaacacagtctacntgcaactgacgagcctgagagctgacgacacggccgtctattactgtgcgagaatgttttcngtcatcgtactaattgataggctctatggactggacttcgtc

SEQ ID NO: 528346 - DNA, 528 bp, Homo sapiens
  misc_feature: HEFZJCU01EK9VE.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgccccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaccgtttgacttttggggccagggaaccctggtcaccgtctcctcagcctccaccaagggcccatcgtcttcccctgcaccctcctccaagagcacctctggggcacagccggcctgggctgcct

SEQ ID NO: 528347 - DNA, 514 bp, Homo sapiens
  misc_feature: HEFZJCU01A1B5I.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggtccggttcaccatctccagagacaattccaagaacacactgtatctgcaaatgaacagcctgagagccgacgacaccggccatatattactgtgcgaaagcaccggcagttagtcacccatactactttgactactggggaccac

SEQ ID NO: 528348 - DNA, 548 bp, Homo sapiens
  misc_feature: HEFZJCU01BQ5YF.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacatggactctgtgaagggccgtttcaccatctccagagacaacgccaagaattcactgtatctacaactgaacagcctgagagtacgcagacacggcccgtgtattactgtgacgagaatggttaggaaaaagtaagtggcctgttgttttagttggggaccgaggggtagcccctgggt

SEQ ID NO: 528349 - DNA, 498 bp, Homo sapiens
  misc_feature: HEFZJCU01D7S8W.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccggggggtccctgagactctcctgtctagtctctggattcgccttcagtgactatgccatgaagtgggtccgccaggctccaggtaagggctggaatggatttcatacattagcagtagtgtgcgaccatatactacgcagactctgtgaagggccgattcatcatctccagagacaatggcaacaactcactgtatctggaaatctaacagcctgagagtgaggacacgctgtatattattgtgcgagacgacccccgtacggtgtacg

SEQ ID NO: 528350 - DNA, 502 bp, Homo sapiens
  misc_feature: HEFZJCU01BQYR5.47.38.D05.1.454.heavy.3.raw
  modified_base (427)..(427): a, c, t, g, unknown or other
  modified_base (445)..(445): a, c, t, g, unknown or other
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgaagnagtctgagcctagacganacggccgtgtattattgtgcgttagttacggacgattacgacgttttgatttggtcg

SEQ ID NO: 528351 - DNA, 513 bp, Homo sapiens
  misc_feature: HEFZJCU01CPRHX.40.73.G07.1.454.heavy.3.raw
tctagcgactcacgaccggtgctcgatttagctctacgctcagggcacgaccggtgctcgatttagacgtctcatcaaggaaggaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcctttttgagtgcctttcgtatatggttggggacc

SEQ ID NO: 528352 - DNA, 499 bp, Homo sapiens
  misc_feature: HEFZJCU01AY0OS.11.57.F02.1.454.heavy.3.raw
  modified_base (438)..(438): a, c, t, g, unknown or other
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacactcactgtatctggaatcaanagcctgagagtcgaggacacggctgtatattattgtgcggagacgccccctacggtcgacg

SEQ ID NO: 528353 - DNA, 507 bp, Homo sapiens
  misc_feature: HEFZJCU01DBQAX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggacaacgacctgagtggatgggatgggcgaaccctaacactggtgtcacagtgtcttcacccatcctccgggacagacttaccatgaccacgaactcctccataaacacagcctacatggagttgaggagccctgtacatctgacgacacggccgtctattactgtgcgagagtcccacgatccggtgagcctacgcgtagcggcctttagcttctc

SEQ ID NO: 528354 - DNA, 498 bp, Homo sapiens
  misc_feature: HEFZJCU01DX7NR.11.72.G06.1.454.heavy.3.raw
  modified_base (470)..(470): a, c, t, g, unknown or other
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggggcctcagtgaaggtctccgtgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagactgacgacacggccctctattactgtgcgaggccctatcctanagtgaccactccacgctggttcgacctc

SEQ ID NO: 528355 - DNA, 530 bp, Homo sapiens
  misc_feature: HEFZJCU01AWS9Y.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggcccatgtattactgtgtgggggcatttacttgaccccttggggcccggggaaccctggtcaccgtctccccaccctccacccg

SEQ ID NO: 528356 - DNA, 509 bp, Homo sapiens
  misc_feature: HEFZJCU01BHH9P.48.19.B08.1.454.heavy.3.raw
  modified_base (473)..(473): a, c, t, g, unknown or other
  modified_base (485)..(485): a, c, t, g, unknown or other
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccgggatattgttatagaaccacctgctatctgngctggtcgacgngtcggcggacgaccggtaccgtcg

SEQ ID NO: 528357 - DNA, 479 bp, Homo sapiens
  misc_feature: HEFZJCU01DIARJ.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagaga

SEQ ID NO: 528358 - DNA, 503 bp, Homo sapiens
  misc_feature: HEFZJCU01BLUR9.52.75.G09.1.454.heavy.3.raw
cgcagtacgacacgaccggtgctcgatttagtatagacatcaggggagctctgagagaggagcccagccctgggattttcaggtgttttcatttggtgatcaggactgaacagagagaactcaccatggagtttgggctgagctggctttttcttgtggctattttaaaaggtgtccatggtgaggtgcggctgttggaatccggggggggcttgatacagcctggggggtccctgagactctcctgtgctgcctctggattcagtttcagtgacttagccatgagctgggtccgccaggctccagggaaggggctggaatgggtctcagtcgttactgctggacttactaccacatactacgcagactccgtgaagggccggttcgccatctccagagacaattccaagaataccctatatctgcaaatgagcagcctgagagccgaggacacggccgtatattactgtgcgatgggaagtagtggttactactactacttt

SEQ ID NO: 528359 - DNA, 510 bp, Homo sapiens
  misc_feature: HEFZJCU01DMT5V.7.25.C03.1.454.heavy.3.raw
  modified_base (466)..(466): a, c, t, g, unknown or other
cgtgtctctacacgaccggtgctcgatttagtagtgtagatttgggtttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcngcctccaccaaggccatcggtcttcccctggccacctcctccaa

SEQ ID NO: 528360 - DNA, 511 bp, Homo sapiens
  misc_feature: HEFZJCU01CV1Z7.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatcggaggtgaggagcctgagatatgacgacacggtccgtgtaattatttgtggcgaggagtggaggtggcgagtcgggatagtacgactaaattacctaactttaa

SEQ ID NO: 528361 - DNA, 537 bp, Homo sapiens
  misc_feature: HEFZJCU01CHBPR.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtgtccttacaatgaccaccatggaccctgtggacacagccacatatttctgtgcacactctataggagcacctggtagtctgccaaactggttcgacccctggggcccgggaacccgtggtcaccgtctcctcacgcctccaccaacgggcccatcggtcttccccctc

SEQ ID NO: 528362 - DNA, 497 bp, Homo sapiens
  misc_feature: HEFZJCU01B2TFS.13.1.A01.1.454.heavy.3.raw
tcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccgagggcagattcaccatgacgacagacacatacacgaacacagcctacatggaggtgaggagcctgagatatgacgacacggccgtgtattattgtgcgagagtggaggtggcaggtggatatcggaccaaatttactactatttaa

SEQ ID NO: 528363 - DNA, 536 bp, Homo sapiens
  misc_feature: HEFZJCU01D0QDR.19.48.E04.1.454.heavy.3.raw
  modified_base (486)..(486): a, c, t, g, unknown or other
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtggggtggccaacataatgcaagatggaactgagaaaaactatggggactctgtgaagggccgattcaccatctccagagacaaccgtaagaacttactgtttctgcaaatgaacagcctgagagccgaggacacgggctgtgtattattgtgcgaagggnagtggctgggacagtggacgtcgtggggccaagggaccacggtcaccgtt

SEQ ID NO: 528364 - DNA, 496 bp, Homo sapiens
  misc_feature: HEFZJCU01CFW55.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccgtgaagggccgattcaccatctccagagacaattccaagaacacgcagtatctgcaaatgaacagcctgagagctgaggacacggctgtcgtattactgtgggagagatgggaggtcgatattgtt

SEQ ID NO: 528365 - DNA, 499 bp, Homo sapiens
  misc_feature: HEFZJCU01DNSJM.3.26.C04.1.454.heavy.3.raw
  modified_base (467)..(467): a, c, t, g, unknown or other
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccagtcgtccttcccctggccgccctgctccaggagcacctccgagcgcacngccggcctgggctgcctggtcaaggacttacc

SEQ ID NO: 528366 - DNA, 525 bp, Homo sapiens
  misc_feature: HEFZJCU01A7MMB.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatcgtgacgacacggcccgtgtattacgtgtgcgaggacggtttttagtggtaattactttaagtttcggttaagttggggtggttaccctggtccttacgttttttc

SEQ ID NO: 528367 - DNA, 508 bp, Homo sapiens
  misc_feature: HEFZJCU01C6WMZ.48.81.H04.1.454.heavy.3.raw
  modified_base (493)..(493): a, c, t, g, unknown or other
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagtttgggtgcgacaggcccctggacacgggcttgagtggatgggatcgatcatccctttctctaatgtcacaagatacacacagagattccagggcagaatcacacttaccgcggacaatccacgggcacagcgcagttggacctgagcgcctgagacctgaggacaccgggccattttactactgtgcgcggggaggtggacggagcttcggttttcggagtttntcatcctactacttt

SEQ ID NO: 528368 - DNA, 504 bp, Homo sapiens
  misc_feature: HEFZJCU01ADKDQ.3.63.F08.1.454.heavy.3.raw
agacgcactccacgaccggtgctcgatttagcgatcgtataaggggctctgagagaggagccttagccctggattccaaggactatccacttggtgatcagcactgagcaccgaggattcaccatggaactggggctccgctgggttttccttgttgctatttttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttgtttgggcgggatagcagcgggtaccc

SEQ ID NO: 528369 - DNA, 526 bp, Homo sapiens
  misc_feature: HEFZJCU01BOSU3.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccaggcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggcttgtctggggccgaggggaccctggtcatcgtctccccagcctccaccaacgggcccatcggtccttccccgtggcc

SEQ ID NO: 528370 - DNA, 518 bp, Homo sapiens; identical to SEQ ID NO: 447436
  misc_feature: HEFZJCU01B1MEJ.13.76.G10.1.454.heavy.3.raw

SEQ ID NO: 528371 - DNA, 544 bp, Homo sapiens
  misc_feature: HEFZJCU01E2DCK.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgaccttttgtgactgcccgcggacacggccgtgtattactgtgcgagagacccctccgatagcagtggctggtcccactaggtttgaccttactggggggtcccaaggggaacgcgtttggtccaccggtcctcctccagcctaccccg

SEQ ID NO: 528372 - DNA, 527 bp, Homo sapiens
  misc_feature: HEFZJCU01DDNN9.9.78.H01.1.454.heavy.3.raw
  modified_base (498)..(498): a, c, t, g, unknown or other
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggcccngggctgcctggtcaaggactacttccacg

SEQ ID NO: 528373 - DNA, 538 bp, Homo sapiens
  misc_feature: HEFZJCU01B0PMK.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacacttggtccgccaggctccaggcaaggggctgaagtgggtggcgtttatttcatatgaatggaactactcaacactatccagactccggggagggccgattcaccgtctcccagagacaattccaagaacagggtgtttctccaagtgattgatctgagaagtgaggacacggctgtttattactgtgcgcggtggctggaccgcgtcttgactacgtgggggccggggacggccccggtctatccgtctccc

SEQ ID NO: 528374 - DNA, 500 bp, Homo sapiens
  misc_feature: HEFZJCU01C1Y79.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggg

SEQ ID NO: 528375 - DNA, 516 bp, Homo sapiens
  misc_feature: HEFZJCU01A35DZ.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaaaccccctccctcaggagtccagtcgccatatccctggactcgtccaacaaccagatctccctgacgatgacatctgtgaccgctgcggacacagccgtttattactgtgcgcgatctgggcgactcagtgactatggtatggacgtcgtggggccaagggaccacggtcatcgtctcctcagcctccaccaaggcccatcggtcttccccctcggcca

SEQ ID NO: 528376 - DNA, 527 bp, Homo sapiens
  misc_feature: HEFZJCU01A4TB0.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtggggaccgccatctacaacccgtccctcaagagtcgagtcagcatgtcagtcgacacgtcccagaaccagttctccctgacagtgagttatatgaccgccgcagacacggccgtgtattactgtgcggagagaggccgtttattttaggaccagctgttaaaaactcctactaccggtctcggacgtcgtggggtccagggggaccaac

SEQ ID NO: 528377 - DNA, 476 bp, Homo sapiens
  misc_feature: HEFZJCU01DZN6S.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcaattgaccagcctgagcgccgaggacacggccatgtattactgtactaaatcgcgggtggccgcggccggtacctcggatggttttgatttctggggccaagggacaatggtcaccgtctcttcagcctccaccaagggccatcggtcttccccctggcaccctcctccaagagcacctctgggggcacagcggccctgggctgcctggtcaaggactacttccgagtagtaca

SEQ ID NO: 528378 - DNA, 529 bp, Homo sapiens
  misc_feature: HEFZJCU01DSXFP.12.11.A11.1.454.heavy.3.raw
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataacagcctgaaagccgaggacacggctggtgtatttctgtgcgaggaccgtcctagggtgaactaaattttattccgaaaccagaaccaaagtttccgg

SEQ ID NO: 528379 - DNA, 511 bp, Homo sapiens
  misc_feature: HEFZJCU01C6S53.48.62.F07.1.454.heavy.3.raw
agtatacatacacgaccggtgctcgatttagtagtcgcataaagggaaagggggagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaacgggccgattcaccatctccagagacaacgccaagcactcactgtatctccaaatgaacagcctgagagccgacgacacggctgtgtattactgtgcgagacttgggagagagtgggacctacgtgttcctacg

SEQ ID NO: 528380 - DNA, 503 bp, Homo sapiens
  misc_feature: HEFZJCU01ETVQ4.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcgaggtattagttggaatagtggtagcataggctatgcggactctgtgaagggccgattcaccatctccagagacaacgccaagaactccctgtatctgcaatgaacagcctgagagctgaggacacggccttgtattattgtgacaaaagataccaaccccttacgtt

SEQ ID NO: 528381 - DNA, 523 bp, Homo sapiens
  misc_feature: HEFZJCU01A576M.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatggctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattacttgacaactggggccagggaaccctggtcaccgtctcctcagcctccaccaagggcccatcggtcttcccctggcgccctgctccaggagcacctccgagaggcacgagccggccctgggctggccttggtcgaaggcgtaactttccg

SEQ ID NO: 528382 - DNA, 505 bp, Homo sapiens
  misc_feature: HEFZJCU01DGYDA.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaggcccatcggtcttcccctggcaccctcctccagagcacctctgggggcacagcggccctgggctgcctggtcaggactacttcctacgtcgtat

SEQ ID NO: 528383 - DNA, 531 bp, Homo sapiens
  misc_feature: HEFZJCU01AX6D7.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagacttccgtgaggggccgagttcaccatctccagagacaattccaagacacgctgttcttcaatgacagcctgagagccgatgacacggccgtgtattactgtgcggagaagatcggggcccaccggtaacgttacgtacgctatggacgtcgtggggaccggaacgggtaccg

SEQ ID NO: 528384 - DNA, 507 bp, Homo sapiens
  misc_feature: HEFZJCU01CZB6V.16.71.G05.1.454.heavy.3.raw
  modified_base (501)..(501): a, c, t, g, unknown or other
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgagggccggttcacccatctccagagacaacttccaagaacacactgtatctgcaaatgaacagcctgagagccgacgacacggccatatattactgtgcgaaaagcaccggcagttagtccacccatactacctttnacttac

SEQ ID NO: 528385 - DNA, 528 bp, Homo sapiens
  misc_feature: HEFZJCU01AGWAE.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattccaccatctccagagacaactctaagaacacgctgtttcttcaatgaacagcctgagagccgatgacacggccgtgtattactgtgcgagagatggggcccacgaacgttactacgctatggacgtcgtggggccaagggaccgtacc

SEQ ID NO: 528386 - DNA, 525 bp, Homo sapiens
  misc_feature: HEFZJCU01BLZ06.16.86.H09.1.454.heavy.3.raw
  modified_base (501)..(501): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccacgtaggtttgacttacgtggggccaggggaancttggtcaccgtctcctcacgcct

SEQ ID NO: 528387 - DNA, 505 bp, Homo sapiens
  misc_feature: HEFZJCU01DIZZ0.52.72.G06.1.454.heavy.3.raw
  modified_base (434)..(434): a, c, t, g, unknown or other
cgcagtacgacacgaccggtgctcgatttagctacgactgcaagggaaaggggtctgggagaggagcccagcactagaagtcggcggtgtttccattcggtgatcagcactgaacacagaggactcaccatggagtttgggctgagctgggttctcctcgttgctcttttaagaggtgtccagagtcaggtgcagctggtggagtctgggggaggcgtggtccagcctgggacgtccctgcgactctcctgttcagcctctggattcaccttctacacctttggcatgttctgggtccgccaggctccaggcaaggggctggagtgggtggcctttatatcatatgatggaactcagaaaaatatgcagattccctgaggggccgactcaccatctccagagacaattccaagagcacactgtttctgcaaatnaacagcctgacgcctggagacacggctgtctactactgtgcgaggccaccaacaccctacggtgactaccg

SEQ ID NO: 528388 - DNA, 514 bp, Homo sapiens
  misc_feature: HEFZJCU01BAWMW.53.80.H03.1.454.heavy.3.raw
cgcgtatacacacgaccggtgctcgatttagctgtgcgtcgaagggaaaggggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcgaccatgaccagggacacgtccatcagcactgcctacatggagctgaccaggctgaaagtttgaggacacgggccagttttattactgttgctaacgggaacagacataatagactccgtacccccggtacttttac

SEQ ID NO: 528389 - DNA, 503 bp, Homo sapiens
  misc_feature: HEFZJCU01BVNJ1.40.81.H04.1.454.heavy.3.raw
tctagcgactcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcacatgacctgggacgcttccatcagcacagtctacatggatctgagcggacttgacctctgaccgacacgggcccatcgtattactgtggaagagacggttggtggctaccggcggggcgtgaccactc

SEQ ID NO: 528390 - DNA, 509 bp, Homo sapiens
  misc_feature: HEFZJCU01A71ZO.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctacttactgtgcgagagtcccacgatccggtgagcctacggcaggcggcctttgacttctggggccagggg

SEQ ID NO: 528391 - DNA, 510 bp, Homo sapiens
  misc_feature: HEFZJCU01BM1CI.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatgggtttagtctgagaactggtgccgcaaattatgcacaggagtttcggggcagggtcatcatgaccggggacacgtccatcgccacacttacatgaactgaccagtctgacatttgacgacacggccgtctattactgtgcgacagaagcggcggacagaggttcgcttactggttcgaggctcctccccacg

SEQ ID NO: 528392 - DNA, 537 bp, Homo sapiens
  misc_feature: HEFZJCU01C65GX.9.37.D04.1.454.heavy.3.raw
tgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggcttcttcttgtggctattttaaaaggtgtccagtgtgaggtgcatctattggagtctgggggagccctggtacagccgggggggtccctgacactctcctgtacagcctctggattcacctttaacacctatgcattgagctgggtccgccaggccccagggaaggggctggactgggtcgcagccattagtggcaatggcgaaaacacatattacgcagactccgtgaagggccggttcaccatttccagagacaatttcaagaacacgctgtatctgcagatgaacagcctgagagccgaggacacggaccgtatatcctacgtgtcgacccaaaagactacaaggaacgggtacgggttcggggggacgtttaacgaaatta

SEQ ID NO: 528393 - DNA, 500 bp, Homo sapiens
  misc_feature: HEFZJCU01AKESJ.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccaagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctagagagctgaggacacggctgtgtattactgtgcgaaagatttctatagaggtgacgtacgggggcttcg

SEQ ID NO: 528394 - DNA, 502 bp, Homo sapiens
  misc_feature: HEFZJCU01BA0E8.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcaccctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctaatgcttttgatatctggggccaagggac

SEQ ID NO: 528395 - DNA, 518 bp, Homo sapiens
  misc_feature: HEFZJCU01AWOUZ.13.39.D06.1.454.heavy.3.raw
tcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtctgggggaggcttggtacagcctggggggtccctgagactctcctgtgcagcctctggattcaccttcagtacctacgacatgcactgggtccgccaacctctaggaaaaggtccggagtgggtctcagggattggcagtgttggtgacacattctattcagactccgtgaagggccgattcaccatctccagagaaatgccaacaactccttccatcttcaaatgaacagcctgagagacggggacacggctgtgtattactgtgcaagaggggcaatttcttattactacttcgacgtcgtggggc

SEQ ID NO: 528396 - DNA, 525 bp, Homo sapiens
  misc_feature: HEFZJCU01DRL5O.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatagcacagaagctccagggcagagtcaccatgaccacagacacatccacgagcacagcctacatgggagctgaggagcctgagatctgacgacacggccgtgtattactgtgcgagagaagggttttactatggttcgggggagtcgtacccgtacccaggcaaacgtcggttacgtacccc

SEQ ID NO: 528397 - DNA, 515 bp, Homo sapiens
  misc_feature: HEFZJCU01C5RB7.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctgggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctggagagccgacgacacggctatctattactgtgcgaaactctcattccgttcatctgaatacgtggggaccacgggaacctggtcgtccg

SEQ ID NO: 528398 - DNA, 509 bp, Homo sapiens
  misc_feature: HEFZJCU01AXIN4.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaaggcccatcggtccttccccctggccaccctcctccaagagcacctctgggggcacagccggccctgggctgcctggtcaaggactacttccgagtagtaca

SEQ ID NO: 528399 - DNA, 395 bp, Homo sapiens; identical to SEQ ID NO: 444494
  misc_feature: HEFZJCU01CVQVS.47.46.E02.1.454.heavy.3.raw

SEQ ID NO: 528400 - DNA, 519 bp, Homo sapiens
  misc_feature: HEFZJCU01EJJEQ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactacgtggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 528401 - DNA, 490 bp, Homo sapiens
  misc_feature: HEFZJCU01D29IH.51.76.G10.1.454.heavy.3.raw
  modified_base (321)..(321): a, c, t, g, unknown or other
cgatcgtatacacgaccggtgctcgatttagtcactcatacagggggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttanatcagatgatggcagtaataaagagtatgcagtctccgtgaagggccgattcaccatctccagagacaattcccagaacacactgtatctgcaaatgaacagattgaagagctgaggacacggtctgtgttatttctgtgcgaaacgctatgagtggggaggttagggt

SEQ ID NO: 528402 - DNA, 514 bp, Homo sapiens
  misc_feature: HEFZJCU01CVFM7.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtggggtggccaacataaatgacgatgcaaaggagacctactatttggactctgtgaggggccgattcatcatctccagagacaacgcgacaactcactgtctctgctgatgagcagcctgagagccgacgacacggcttatctatttactgtgcgaaactctcattccgttcatctgaatactggggccagggaaccctggtccgtccg

SEQ ID NO: 528403 - DNA, 528 bp, Homo sapiens
  misc_feature: HEFZJCU01ERGC0.17.34.D01.1.454.heavy.3.raw
  modified_base (437)..(437): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgacagcctgtcatctgagganacgggcttctacttctgtgcgaggagtaattactataacactgctacctttttacacctcccttgacttctggggccatcggaaccccggt

SEQ ID NO: 528404 - DNA, 418 bp, Homo sapiens; identical to SEQ ID NO: 446028
  misc_feature: HEFZJCU01BIPP7.16.28.C06.1.454.heavy.3.raw

SEQ ID NO: 528405 - DNA, 508 bp, Homo sapiens
  misc_feature: HEFZJCU01DWV0L.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttggaggagccgtgacatctgacgacacggccgtctattactgtgcgagagtcccacgatccggtgacgcctacggcaggcggcctttgacttcgtc

SEQ ID NO: 528406 - DNA, 520 bp, Homo sapiens; identical to SEQ ID NO: 447654
  misc_feature: HEFZJCU01AUCD4.10.79.H02.1.454.heavy.3.raw

SEQ ID NO: 528407 - DNA, 499 bp, Homo sapiens
  misc_feature: HEFZJCU01DBV4Z.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtatttattgtgcgagagtggagtggcgagtggatagtacgacaaatttactactta

SEQ ID NO: 528408 - DNA, 534 bp, Homo sapiens
  misc_feature: HEFZJCU01EEXN6.16.87.H10.1.454.heavy.3.raw
  modified_base (469)..(469): a, c, t, g, unknown or other
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagttctgacgacccgaggacacggctgtgtattactgtgngaaggcagttcgtagaacagttatggttggggggagtttggggttttttttcgttacgtacgggt

SEQ ID NO: 528409 - DNA, 513 bp, Homo sapiens
  misc_feature: HEFZJCU01D1QKM.13.28.C06.1.454.heavy.3.raw
  modified_base (445)..(445): a, c, t, g, unknown or other
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgacggggccgattcaccatctccagagacaattccaagaacacgctgtttcttcaaatgaacagcctganagccgatgacacggcctgtattactgtgcgagagatggggcccacgaacgttactacgctatggtacg

SEQ ID NO: 528410 - DNA, 501 bp, Homo sapiens
  misc_feature: HEFZJCU01CKWIZ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccactaaacacagcctacatggagttgaggagcctgacatctgacgacacggccgtctattactgtgcgagagtccacgatccggtgagcctacggcagcggcctttgacttc

SEQ ID NO: 528411 - DNA, 510 bp, Homo sapiens
  misc_feature: HEFZJCU01D7ESS.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtctttgactactggggctgggactctgtcaccgtctcc

SEQ ID NO: 528412 - DNA, 520 bp, Homo sapiens
  misc_feature: HEFZJCU01DX9MS.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccaggggaaccctggtactaccg

SEQ ID NO: 528413 - DNA, 526 bp, Homo sapiens
  misc_feature: HEFZJCU01COMLW.49.65.F10.1.454.heavy.3.raw
agtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcagttatctcagatgatggaagtaaaaagtactattcggactccttgaagggccgattcaccatctccagagacaattccaagaacaccttgcatctacaaatgcacagtctgagacctgaggacacgggctgtgtattactgtgcggaaggggggagggggatttttgctattgggaccccacttgactacgtgggggccgaac

SEQ ID NO: 528414 - DNA, 550 bp, Homo sapiens
  misc_feature: HEFZJCU01B74IH.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatggtaggaaaaagtaagtgacgttgttgttttagttgggggccaggggacgcccgtgggtcctaccc

SEQ ID NO: 528415 - DNA, 496 bp, Homo sapiens
  misc_feature: HEFZJCU01DL563.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaaatacaaatttatgcacccattctgttgagagtcgactgacaatcaacgtagacacatcgaagaaccagttctccctgcagctgacctactgtgactcccgaggacgacgggtgtatattactgtggaagaggcccccgatacgacatgccacctccgtctctggtgcttacg

SEQ ID NO: 528416 - DNA, 540 bp, Homo sapiens
  misc_feature: HEFZJCU01AUXAG.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggaccacggcgaagaaccagttctccctcgaactgaccgctgtgaccgccgcggacacggctgtgtattactgtgcgagacgaagtgggcgggtggcgtacgacttgacttttggggccgagggaaaccgtggtcaccgtcctccccacgccttccaccgaacgggcccactccggtcctttcccccg

SEQ ID NO: 528417 - DNA, 503 bp, Homo sapiens
  misc_feature: HEFZJCU01EUYQ0.17.10.A10.1.454.heavy.3.raw
  modified_base (414)..(414): a, c, t, g, unknown or other
  modified_base (451)..(451): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagccngagagctgacgacacgggccgtctattactgtgcganaatgttttctgtcatcgtacaatttgataggctctatggactggacttcgtc

SEQ ID NO: 528418 - DNA, 542 bp, Homo sapiens
  misc_feature: HEFZJCU01BL0P3.14.26.C04.1.454.heavy.3.raw
cgtctagtaccacgaccggtgctcgatttagtctagcgactttgggtttgggggtctcagagaggagccttagccctggactccaaggcctttccacttggtgatcagcactgagcacagaggactcaccatggagttggggctgagctgggttttccttgttgctattttagaaggtgtccagtgtgaggtgcagttggtggactctgggggaggcttggtccagcctggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgaggagacgtttagggttttaaacttttagactagttggggccgagggaaccctggtcaccgtct

SEQ ID NO: 528419 - DNA, 512 bp, Homo sapiens
  misc_feature: HEFZJCU01AVTNA.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggtctttttgatgtcctttgactatgtgggggccgaaggggacaagtggttccg

SEQ ID NO: 528420 - DNA, 520 bp, Homo sapiens
  misc_feature: HEFZJCU01CM9CP.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagccacctctcgggggcacagcggccctgggctgcctggtcaagactacttcctagagacacg

SEQ ID NO: 528421 - DNA, 511 bp, Homo sapiens
  misc_feature: HEFZJCU01EHBTI.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggccatcggtcttcccctggcgccctgctccaggagcacctccgagagcacagcggccctcggg

SEQ ID NO: 528422 - DNA, 510 bp, Homo sapiens
  misc_feature: HEFZJCU01DT4PD.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacggtccatcagcactgcctacatggagctgaccaggctgaaatttggaggacgacggccatttatttactggtgcaaggaacagacataaatgaccgtcgtcccccggtactttacgg

SEQ ID NO: 528423 - DNA, 482 bp, Homo sapiens
  misc_feature: HEFZJCU01ELNZQ.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcaacaaagtatgcacagaagtttcagggcagggtcaccatagaccagggacaccgtccatcagcaacgtccatcagcacagcctacatgacctgagcggcctgacatctgacgacacggccgtaatactttctgtgcgga

SEQ ID NO: 528424 - DNA, 544 bp, Homo sapiens
  misc_feature: HEFZJCU01EZIEX.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgttgacagcccgcggacaccgggcgtttattactgtgcgagaggggacggacgtacggtgactactgggggttcgtaccccgtcggggtccgaggggaacccgtagggtcaccgtcctccctcagcctccaacccg

SEQ ID NO: 528425 - DNA, 545 bp, Homo sapiens
  misc_feature: HEFZJCU01CUYD1.13.33.C11.1.454.heavy.3.raw
tcacgtactacacgaccggtgctcgatttagagtgagctcgttgggtttgggggggagaggagcccagcactgggattccgaggtatttccattcggtgatcagcactgaacacagaggactcaccatggagttttggctgagctgggtttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctccagagacaattccaagaacacggtgtatcttcaaatgaacgacctgagagtcgaggacacggccgtctattactgtgcgaagaatgcagagacgggccccgtaagtcggggcctgggtggagggttctttctttgtactgcgtggggccgac

SEQ ID NO: 528426 - DNA, 504 bp, Homo sapiens
  misc_feature: HEFZJCU01BU3Z8.17.10.A10.1.454.heavy.3.raw
  modified_base (445)..(445): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggttaaggcacagtatgcaccgaagatgaagggcagagtcacgattaccacggaccacccccacgaacacagtctacatgcaactgacgagcctgagagctgacgacacggccgtctattacngtgcgagaatgttttctgtcatcgtacaatttgataggctctatggactggacttcgtc

SEQ ID NO: 528427 - DNA, 530 bp, Homo sapiens
  misc_feature: HEFZJCU01CCXMP.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctccttttacacctcccttgacttcgtggggccatcggaaccccggtcaccgt

SEQ ID NO: 528428 - DNA, 516 bp, Homo sapiens
  misc_feature: HEFZJCU01DI6QG.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggcccatcggtccttcccctggcaccctcctccaagagcacctctggggcacagcggccctggctgcctggtcaaggactacttcctagagacacg

SEQ ID NO: 528429 - DNA, 522 bp, Homo sapiens
  misc_feature: HEFZJCU01CP5RR.49.86.H09.1.454.heavy.3.raw
  modified_base (492)..(492): a, c, t, g, unknown or other
agtcgagagacacgaccggtgctcgatttagtgctatagacttgggtttggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaaattcgaagaacaccatgtatctggaactgagcagagtcacatctgaggacacggctatcgtattactgtgtgaaagacttttangacagtagtggtttctccgtagtatgctac

SEQ ID NO: 528430 - DNA, 507 bp, Homo sapiens
  misc_feature: HEFZJCU01A441I.4.81.H04.1.454.heavy.3.raw
  modified_base (470)..(470): a, c, t, g, unknown or other
  modified_base (485)..(485): a, c, t, g, unknown or other
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacacgccaagaactcagtgtttctgcaaatgaacagcctgagagtcgaggactcggctgtctactactgtncgaggaataagggancctaccctacgatttggactac

SEQ ID NO: 528431 - DNA, 497 bp, Homo sapiens
  misc_feature: HEFZJCU01CL3BB.18.50.E06.1.454.heavy.3.raw
  modified_base (433)..(433): a, c, t, g, unknown or other
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaanagcctgacagtcgacgacacggccatgtattttgtgcgagcgaccgggctcctcaatggctttc

SEQ ID NO: 528432 - DNA, 497 bp, Homo sapiens
  misc_feature: HEFZJCU01EDTMO.52.62.F07.1.454.heavy.3.raw
cgcagtacgacacgaccggtgctcgatttagtagtcgcataaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaagaacacgctgtatttgcaaatgaacagcctgagagctgaggacacggctgtgtattactgtgcgtaacttaatcacggtaggacg

SEQ ID NO: 528433 - DNA, 498 bp, Homo sapiens
  misc_feature: HEFZJCU01EQ8D3.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgcttttgatgccttgatatgtgggccgaaggacaatggtccg

SEQ ID NO: 528434 - DNA, 508 bp, Homo sapiens
  misc_feature: HEFZJCU01D8J2Q.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtcgaccgccgcggacacggctgtgtacttctgtgcgagaggcaattttggactcgtcattcttccctttgacttctcggggccacggggaacccta

SEQ ID NO: 528435 - DNA, 498 bp, Homo sapiens
  misc_feature: HEFZJCU01C8AMT.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctcctgaagctgagctctgtgaccgccgcagacacggctgtctattactgtgcgaggccccgagcgcagtggcttttgatgcctttgatatgtgggcagggacaagtgcacgtc

SEQ ID NO: 528436 - DNA, 496 bp, Homo sapiens
  misc_feature: HEFZJCU01EEVXU.9.86.H09.1.454.heavy.3.raw
tgatacgtctcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtggggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctcgtggggccaagggacactggtcaccgtctcttcagcctccaccaaggcccatcggtcttcccctggccgcc

SEQ ID NO: 528437 - DNA, 517 bp, Homo sapiens
  misc_feature: HEFZJCU01ALGRL.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaataacctgagaggcgaggacacggccatttatttctgtgcgaaggaggcatatgggaagtacgattttcgatccctccgcagtcgacactttgattactggggccgggaacctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 528438 - DNA, 508 bp, Homo sapiens
  misc_feature: HEFZJCU01A32DT.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcggacccggggctcctcaatggctttcatttacg

SEQ ID NO: 528439 - DNA, 393 bp, Homo sapiens
  misc_feature: HEFZJCU01CLTUU.49.46.E02.1.454.heavy.3.raw
agtcgagagacacgaccggtgctcgatttagactcatctacagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtcgtcctcagcctccaccaagggcccatcggtcttccccctggccaccctcctccaagagcacctctgggggcacagcggcctgggctgcctggtcaaggactacttcctctctcgact

SEQ ID NO: 528440 - DNA, 523 bp, Homo sapiens
  misc_feature: HEFZJCU01D73QB.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaaggcccatccggtcttcccctcggccaccctcctccaagagcacctctgggggcacg

SEQ ID NO: 528441 - DNA, 541 bp, Homo sapiens
  misc_feature: HEFZJCU01C6L5D.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcgccatctccagagacaacgccaagaattcactgtatctacaactgaacagcctgagagtcgcagacacggccgtgtacttactgtgcgagatgtaggaaaaagtatggctgtgttttagtggggtccgagggacgccctggtctaccg

SEQ ID NO: 528442 - DNA, 512 bp, Homo sapiens
  misc_feature: HEFZJCU01A7ZUQ.48.81.H04.1.454.heavy.3.raw
  modified_base (500)..(500): a, c, t, g, unknown or other
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggccccctggacacgggcttgagtggatgggatcgatcatccctttctctaatgtcacaagatacacacagagattcccagggtcagaatcacacttaccgcggacaaatccacggggcacagcgcagttggacctgagcggcctgagaccgtgacggacacggccatttactactgtgcgcgggggacgtaggaggagctcggttttcggagttatacntctactactttg

SEQ ID NO: 528443 - DNA, 552 bp, Homo sapiens
  misc_feature: HEFZJCU01D8MKG.16.86.H09.1.454.heavy.3.raw
  modified_base (518)..(518): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggacttgggaacatctattacagcgggagcaccaactacaacccgtccctcaagagtcgagttaccatttcattaaacacgtctaagaaccagttctccctgaagctgacctttgtgactgccgcggacacgggccgtgtattactggtgcggagacgaccccgtccgatagcagtcggcttgggtcccaacgttagggtttgactacgtgggggacccagggggtaancgtttggtccaccggttcctcctcagccctaccc

SEQ ID NO: 528444 - DNA, 519 bp, Homo sapiens
  misc_feature: HEFZJCU01EJVGD.51.24.C02.1.454.heavy.3.raw
cgatcgtatacacgaccggtgctcgatttagtacagatcgttagggaaagggggggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccaggcaaggggctggaatgggtggcagttatttcgtccactggaaacagtaaacattatggacgctccgtgaagggcccattcgccatctccagagacaattccaaaaataccctctatctgcgaatgaacagcctgcgacctgaagacacggctatatatttctgtgcgagaggggagtcttattagtaatgatggttcctgctattcgttttt

SEQ ID NO: 528445 - DNA, 350 bp, Homo sapiens; identical to SEQ ID NO: 444420
  misc_feature: HEFZJCU01A6MBD.40.36.D03.1.454.heavy.3.raw

SEQ ID NO: 528446 - DNA, 506 bp, Homo sapiens
  misc_feature: HEFZJCU01EFGKV.53.53.E09.1.454.heavy.3.raw
cgcgtatacacacgaccggtgctcgatttagagagagtgtgttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagactgaggacacggccgtgtattactgcgcgagagtgcatgatagtggtttccatgatgcttttg

SEQ ID NO: 528447 - DNA, 505 bp, Homo sapiens
  misc_feature: HEFZJCU01AIT66.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgtagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctactatggagttgaccaggcctcgaccgacacggccgttgttatttttgtgttgagagtattttccggtacaagtccagaacgtaaccccgtgtc

SEQ ID NO: 528448 - DNA, 510 bp, Homo sapiens
  misc_feature: HEFZJCU01DGD51.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggccacggacgttactacgctatggtacgtctgggg

SEQ ID NO: 528449 - DNA, 526 bp, Homo sapiens
  misc_feature: HEFZJCU01BD0RF.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctgggagtgggtggccaacataaatgacgatgcaaaggagacctactatttggactctgtgaggggccgattcatcatctccagagacaacgccgacaactcactgtcctctgctgatgagcagcctgagagccgacgacacggctatctattacttgtgcgaaactctcattccgttacatctgaattacgtgggggtaccaggggaaccccgtggtccggtccgg

SEQ ID NO: 528450 - DNA, 503 bp, Homo sapiens
  misc_feature: HEFZJCU01AUPWD.11.57.F02.1.454.heavy.3.raw
  modified_base (404)..(404): a, c, t, g, unknown or other
  modified_base (441)..(441): a, c, t, g, unknown or other
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagngacaatggcaacaactcactgtatctaggaatcaacngacctgagagtcgaggacacggctgtatattattgttgcgagacgccccctacggtgtaccg

SEQ ID NO: 528451 - DNA, 506 bp, Homo sapiens
  misc_feature: HEFZJCU01EW7C3.10.71.G05.1.454.heavy.3.raw
catagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtatgtgacttccggggcagggaccgtggtcaccgtctccg

SEQ ID NO: 528452 - DNA, 390 bp, Homo sapiens; identical to SEQ ID NO: 444541
  misc_feature: HEFZJCU01CCSUR.16.24.C02.1.454.heavy.3.raw

SEQ ID NO: 528453 - DNA, 505 bp, Homo sapiens
  misc_feature: HEFZJCU01BKQTH.3.67.G01.1.454.heavy.3.raw
  modified_base (379)..(379): a, c, t, g, unknown or other
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggagcttggtgcagccgggtgggtccctgcgactctcctgtgcaatttctgaagcccttccaatacagtgtggatgaattgggtccgccaggctccagggaaggggctggagtgggttggccatataaaaagtaagactgctggtgagacaacagacacgtttcngctgccttcagaggcagattcaccatcttcagagatgaatcacagagcactctgtttctgcaaatgaacagcctggaagacgcggacacagccatgtattattgtacagttaggactactataccg

SEQ ID NO: 528454 - DNA, 534 bp, Homo sapiens
  misc_feature: HEFZJCU01B92N4.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcgtggggccagggggaccctggtcagtcgtctccccagccctccaccaaggggccccagttccggtctttcccccgtggccg

SEQ ID NO: 528455 - DNA, 506 bp, Homo sapiens
  misc_feature: HEFZJCU01CA2MD.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcactctgggggcacagcggccctggctgcctggtcaggactacttcctacgtcgtat

SEQ ID NO: 528456 - DNA, 507 bp, Homo sapiens
  misc_feature: HEFZJCU01AP4SL.12.25.C03.1.454.heavy.3.raw
atacgacgtacacgaccggtgctcgatttagtagtgtagatttgggtttgggtgccgaagttgctggaggtcacggtcaccacgctgctgagggagtagagtcctgaggactgtagggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactacgtggggcctgggactcgtggtcaccgttctcctcacgcctacccg

SEQ ID NO: 528457 - DNA, 539 bp, Homo sapiens
  misc_feature: HEFZJCU01BSH1E.17.28.C06.1.454.heavy.3.raw
  modified_base (525)..(525): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcgaccatctccagagacaacgccaagaattcactgtatctacaactgaacagcctgagagtcgcagacacggccgtgtacttactgtgcgagatgtggaaaagtaatggctgtgtttattggggccaggggancccgtggtctaccg

SEQ ID NO: 528458 - DNA, 529 bp, Homo sapiens
  misc_feature: HEFZJCU01D24YF.48.5.A05.1.454.heavy.3.raw
agtatacatacacgaccggtgctcgatttagatagatagacagggggctctgagagaggagcccagccctgggatttttcaggtgttttcatttggtgatcaggactgaacagagagaactcaccatggagtttgggttgagctggcttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaagggctggagtgggtctcatctattagtgagactggtgatactacagactacgcagactccgtgagggccggttcaccgtctccagagacaattccaagaacacgctatttctgcaaatgaacagcctgagagtcgacgacacggccgtatactactgtagcgagacagatgctgccgccgtcgttccggtggggaccgagggaaccctgggtccaccgtt

SEQ ID NO: 528459 - DNA, 405 bp, Homo sapiens
  misc_feature: HEFZJCU01CTLNZ.3.17.B06.1.454.heavy.3.raw
agacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattccgcggtgggtctactgggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 528460 - DNA, 511 bp, Homo sapiens
  misc_feature: HEFZJCU01CXUGC.53.19.B08.1.454.heavy.3.raw
cgcgtatacacacgaccggtgctcgatttagtgagtcagtaaggggtctgggagacgagcccagcactggaagtcgccggtgtttccattcggtgatcatcactgaacacagaggactcaccatggagtttgggctgacctgggttttcttcgttgctcttttaagaggtgtccagtgtcaggtgcagctggtggagtcggggggaggcgtggtccagcctgggaagtccctgagactctcctgtgcggcctctggattcagtttcagttggtacggcatgcactgggtccgtcaggctccaggcaaggggctggagtgggtggcaattatatcgtatgatggaaccaaaagaaactacgcagactccgtgaagggccgcttcagtatctccagagacgatcgccgggacaccctttatttgcaaatgagcagcctgagagttggagacacggctgtatattactgtgcgagagacaaacctgaatatagcactggcgtggcagggcctta

SEQ ID NO: 528461 - DNA, 504 bp, Homo sapiens
  misc_feature: HEFZJCU01BFNG2.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatgaacagcctagagagtcgaggacacggctgtgtattactgtgcgagagagtccgggagggggacgtatgacc

SEQ ID NO: 528462 - DNA, 520 bp, Homo sapiens
  misc_feature: HEFZJCU01CK0K0.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattccaccatctccagagacaacgccaagaattcagtgtatctgcaaatgaacagcctgacgagccggaaggacacggcgtcgtattacgtgtgtgagagacatgacaacggtgactaaccgggaggggttg

SEQ ID NO: 528463 - DNA, 512 bp, Homo sapiens
  misc_feature: HEFZJCU01DDJ5Z.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggccttttgactttctggggccgagggacg

SEQ ID NO: 528464 - DNA, 384 bp, Homo sapiens
  misc_feature: HEFZJCU01B4WHO.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtccaccgtctcctcagcctccaccaagggcccatcggtcttccccctggcaccctcctccaagagcacctctgggggcacagcggccctgggctgcctggtcaaggactacttcctacgtgagct

SEQ ID NO: 528465 - DNA, 503 bp, Homo sapiens
  misc_feature: HEFZJCU01BXG47.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctgggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgacgaaagtatttctatagaggtagacgtac

SEQ ID NO: 528466 - DNA, 491 bp, Homo sapiens; identical to SEQ ID NO: 446104
  misc_feature: HEFZJCU01BY5AN.3.34.D01.1.454.heavy.3.raw

SEQ ID NO: 528467 - DNA, 518 bp, Homo sapiens
  misc_feature: HEFZJCU01CZ1YA.3.6.A06.1.454.heavy.3.raw
agacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttactactactggagttggatccggcagtccccagggaagggactagagtgggttggccatatgcatcacagtgggagcaccaactacaacccctccctcgagagtcgagtcaccatatcaatagacacgtccaagaaccagttctccctgagcttgaagtctgtcaatgctgcggacacggccgtttattactgtgcgagtactgcggggaaagatccatttgatagtttggggaccaaggaacaataggtcacgtctcttcagcctccacaacggg

SEQ ID NO: 528468 - DNA, 513 bp, Homo sapiens
  misc_feature: HEFZJCU01B8EK6.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctcctttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgtcgagagtacgtagcggctcgtcctttgactactggggcctgggaactctggtcaccgtct

SEQ ID NO: 528469 - DNA, 401 bp, Homo sapiens
  misc_feature: HEFZJCU01A7DK7.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagccctccaccaagggcccatcggtcttccccctggcgccctgctccaggagcacctccgagagcacagcggccctgggctgcctggtcaaggactacttcctacgtgagct

SEQ ID NO: 528470 - DNA, 518 bp, Homo sapiens
  misc_feature: HEFZJCU01DCYYE.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacgacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcaccctcctccagagcacctctgggggcacagcggccctgggctgcctggtcaaggactacttccagacgtatca

SEQ ID NO: 528471 - DNA, 505 bp, Homo sapiens
  misc_feature: HEFZJCU01EBQQH.51.71.G05.1.454.heavy.3.raw
cgatcgtatacacgaccggtgctcgatttagtgtcgtcgcaagagagaggggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattccaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctattgttttactgttgcgagagggtaactacgatacagcacg

SEQ ID NO: 528472 - DNA, 517 bp, Homo sapiens
  misc_feature: HEFZJCU01D1MA3.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttatggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaagtgaacaacctgagagccgaggacacggctgtgtattactgtgtgagagatgttctgcgttggggccagggaccctggtctaccg

SEQ ID NO: 528473 - DNA, 505 bp, Homo sapiens
  misc_feature: HEFZJCU01DITIM.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtatgccttagtatatgttgggcgaagggacaatggtccaccgtctcgtt

SEQ ID NO: 528474 - DNA, 522 bp, Homo sapiens
  misc_feature: HEFZJCU01DIVLT.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgacccgtgaagggccgattaaccatctccagagacgattccgagaacacggtgtatcttcaaatgaacaacctgagagccgacgacacggccgttattactgtgcgagagattcgagtggttcggggacctcaccctggttctacttcgatctctggggccgtc

SEQ ID NO: 528475 - DNA, 536 bp, Homo sapiens
  misc_feature: HEFZJCU01BI2YG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcagtcgtctccccacgcctccaccgaagggcccagtccggtccttcccccgtggccgccctcg

SEQ ID NO: 528476 - DNA, 493 bp, Homo sapiens
  misc_feature: HEFZJCU01CWXJL.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacaacggtctatctgcactgaccagcctgagaactgacgacacgtctctctactactgtgcgagagagttgacgagtct

SEQ ID NO: 528477 - DNA, 508 bp, Homo sapiens
  misc_feature: HEFZJCU01DNAE7.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctggacatctgacgacaacggccgtactattactgtgcgagagtcccacgatccggtgagcctacggcagccggccttttgcttcgtc

SEQ ID NO: 528478 - DNA, 485 bp, Homo sapiens
  misc_feature: HEFZJCU01ATTYL.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgccgcagcctgagatctgaagacacggccatttattactgtgcgagagatgcagggccctcccacatcggttta

SEQ ID NO: 528479 - DNA, 542 bp, Homo sapiens
  misc_feature: HEFZJCU01A3N5G.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacaccccccaaaaaccacggtggtccttacaatgaccaccatggaccctgtggacacagccacatatttctgtgcacactctataggagcacctggtagtctgccaaactggttccgacccctcggggcccgggaacccgtcggtcaccggtctcctcagcctccaccgaagggcccatcggtcttcccctc

SEQ ID NO: 528480 - DNA, 515 bp, Homo sapiens
  misc_feature: HEFZJCU01DTWBZ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctctcagcctccaccaaggcccatcggtcttcccctggcaccctcctccaagagcacctctgggggcacagcggccctgggctgctggtcaaggactacttcctagagacacg

SEQ ID NO: 528481 - DNA, 500 bp, Homo sapiens
  misc_feature: HEFZJCU01DMRNQ.11.73.G07.1.454.heavy.3.raw
cgagagataccacgaccggtgctcgatttagctctacgctcagaggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctggggaagggccggagtggatttcatacatcagtagtagtggtaacaccttgtactatgcagactctgtgaagggccgattcaccatctccagagacaacgccaagaattcactgtttctgcaatagaacagcctgagagacgaggatacggctatttactattgtgcgcgatcgacaagaaaacgacggtggcctac

SEQ ID NO: 528482 - DNA, 523 bp, Homo sapiens
  misc_feature: HEFZJCU01AK7SM.47.78.H01.1.454.heavy.3.raw
  modified_base (416)..(416): a, c, t, g, unknown or other
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtcccccagggaaggggctggaatggattcgacaggtcaatcattacagatccaccaactacaacccgtcccncagcagtcgagtcaccttttcgcttgacacgtccaacaaccagttttctctgatcaaaacccgagaaccgccgcggacagcctccggccctggggcccagaaacccg

SEQ ID NO: 528483 - DNA, 500 bp, Homo sapiens
  misc_feature: HEFZJCU01BV84L.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctgggaatgggtggcagatatacaatatgatgacagtaaaatatactatggagactccttcaagggccgattcaccatctccagagacaattccaagaacatggtgtatctgcaaatgacagcctgagagaccgaggacacgggtgtttattactggtgggagaaatcctagtggcatcaccgtgtatt

SEQ ID NO: 528484 - DNA, 505 bp, Homo sapiens
  misc_feature: HEFZJCU01A3J4O.51.78.H01.1.454.heavy.3.raw
  modified_base (489)..(489): a, c, t, g, unknown or other
cgatcgtatacacgaccggtgctcgatttagtgtgagtagtttgggtttgggggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacanctggtactcaattacg

SEQ ID NO: 528485 - DNA, 532 bp, Homo sapiens
  misc_feature: HEFZJCU01BNRXU.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaatttctggtaccacatactactccgaccccgtgaaagggccgattaaccatctccagagacgattccgagaacacggtgtatcttcaaatgaacaacctgagagccgacgacacggccgttttacgttaactggtgcggagagattcggagtgggttcgggggaccctcaccctggttctacttcgatctcgtc

SEQ ID NO: 528486 - DNA, 512 bp, Homo sapiens
  misc_feature: HEFZJCU01D0BPF.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggaccacggccacatattactgttgcgaaagatcgtcgggctggttccggcggtccgggt

SEQ ID NO: 528487 - DNA, 506 bp, Homo sapiens; identical to SEQ ID NO: 446520
  misc_feature: HEFZJCU01E0OIK.10.38.D05.1.454.heavy.3.raw

SEQ ID NO: 528488 - DNA, 519 bp, Homo sapiens
  misc_feature: HEFZJCU01B8VTO.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgaatccctccgcagtcgacactttgattactggggccggggaaccctggtcgccgtctcctcagcctccaccaagggcccatcggtcttcccctggcaccctcctcccaagagcacctctgggggcacagcggccctggctgcctggtcaaggactacttccagacgtatca

SEQ ID NO: 528489 - DNA, 520 bp, Homo sapiens
  misc_feature: HEFZJCU01BNTGH.49.26.C04.1.454.heavy.3.raw
agtcgagagacacgaccggtgctcgatttagtctagcgactttgggtttgggggggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatggtggtatcacctactatgcagactctgtgaagggtcgattcaccatctccagagacaacagcagaactccctgtatctgcaaatgaacagtctcagaggtgaggacaccgccttctactactgtgcaaaagattacggtgaccaaccacccttattttcgaccactgccggccaac

SEQ ID NO: 528490 - DNA, 516 bp, Homo sapiens
  misc_feature: HEFZJCU01CLZMF.49.23.C01.1.454.heavy.3.raw
agtcgagagacacgaccggtgctcgatttagtacacgtgattagggattggggagcatcacataacaaccagattcctcctctaaagaagcccctgggagcacagctcatcaccatggactggacctggaggttcctctttgtggtggcagcagctacaggtgtccagtcccaggtccagctggtgcaatctgggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactatttcatggaactgagcagcctcagatccgaggacaccggccgtttactacgttgtggcgaggacgactcccgggattccccggtcggtttccggaggtatagaacctacgt

SEQ ID NO: 528491 - DNA, 520 bp, Homo sapiens
  misc_feature: HEFZJCU01BO4NA.7.78.H01.1.454.heavy.3.raw
cgtgtctctacacgaccggtgctcgatttagtgtgagtagtttgggtttgggattcacgttgcaactggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaacgagcacctctcgggggcacagcgccctgggctgcctggtcaaggactacttcctagagacacg

SEQ ID NO: 528492 - DNA, 510 bp, Homo sapiens
  misc_feature: HEFZJCU01DAXA6.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacagccgggggggtccctgagactctcctgtgcagcctctggattcagttttagaatgtctgccatgacctgggtccgccaggctcctgggaaggggctggagtggatctcagggattagtggcactgggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 528493 - DNA, 531 bp, Homo sapiens
  misc_feature: HEFZJCU01DZ5LR.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaacgggcccatcggtcttccccctggccaccctccctccaagagctacctctgggggcacagcggccctgggctgcctggtcaaggactacttccg

SEQ ID NO: 528494 - DNA, 497 bp, Homo sapiens
  misc_feature: HEFZJCU01BXUN6.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtgtattactgtgggagagatgggaggtcgattagttgta

SEQ ID NO: 528495 - DNA, 505 bp, Homo sapiens
  misc_feature: HEFZJCU01DHBEG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccatcctccgggacagacttaccatgaccacgaactcctccataaacacagcctacatggagttgaggagcctgacatctgacgacacggccgtctattactgtgcgagagtcccagactcggtgagcctacggcaggccggtcctttgacttcgtc

SEQ ID NO: 528496 - DNA, 542 bp, Homo sapiens
  misc_feature: HEFZJCU01D04BQ.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaagggctggagtgggttggacgtttcaaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggactatgcttttgatatctggggcccagggac

SEQ ID NO: 528497 - DNA, 481 bp, Homo sapiens
  misc_feature: HEFZJCU01BAVMO.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccagggcccatcggtcttcccctggcgccctgctccaggagcacctccgagagcacagcggccctggctgcctggtcaaggactacttcccactactatg

SEQ ID NO: 528498 - DNA, 507 bp, Homo sapiens; identical to SEQ ID NO: 458256
  misc_feature: HEFZJCU01EKJMN.11.72.G06.1.454.heavy.3.raw

SEQ ID NO: 528499 - DNA, 529 bp, Homo sapiens
  misc_feature: HEFZJCU01C32LJ.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggaagcctgatccaggccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttacaatgaacagcctgacagtcgacgacacggccatgttatttttgtgtcgagccggacccggggctcctcaatggtctttcattacgtggggccacgggtaacccg

SEQ ID NO: 528500 - DNA, 530 bp, Homo sapiens
  misc_feature: HEFZJCU01A93I2.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttcggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactggggtccgccaggttccagggaaggggctggagtggggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtggg

SEQ ID NO: 528501 - DNA, 504 bp, Homo sapiens
  misc_feature: HEFZJCU01ARX47.49.85.H08.1.454.heavy.3.raw
agtcgagagacacgaccggtgctcgatttagtatcactcagtcgcgggggtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtgggtgtgggctggatccgtcagcccccaggaaaggccctggagtggcttgcactcatttattggaatgaacgataagacctacagcccatctctgaagagcaggctcaccatcaccaaggacacctccaacaaccagtggtccttacaatgaccaacatggaccctgtggacacagccacatattactgtgcacaccgtccccccgccgtattattatgatgctagtggtttacttccaaccgctgaattaccttccagccactcgggggccacgggg

SEQ ID NO: 528502 - DNA, 543 bp, Homo sapiens
  misc_feature: HEFZJCU01EINPL.17.28.C06.1.454.heavy.3.raw
  modified_base (486)..(486): a, c, t, g, unknown or other
cgtagactagcacgaccggtgctcgatttagagctcacgtattgggtttggggaggtctcagagaggaggcttagccctggactccaaggcctttccacttggtgatcagcactccgagcacagaggactcaccatggagttggggctgaactgggttttccttgttgctgttttagaaggtgtccagtcgtgaggtccagttggttgagtccgggggaggcctggtccagcctggggggtccctgagactctcctgtgcagcctccggattcccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcganatgtaggaaaaagtatggctgttgtttagttggggccagggagcccctggtctaccg

SEQ ID NO: 528503 - DNA, 508 bp, Homo sapiens
  misc_feature: HEFZJCU01B6WRN.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtcccaagaaccaattctccctgaagctgagctctgtgaccgccgcagacacggctgtctattactgtgcgaggccccgagcgcagtggctttttgatgcctttgatatgtggggccgaagggacaagtaggtcaccgt

SEQ ID NO: 528504 - DNA, 509 bp, Homo sapiens
  misc_feature: HEFZJCU01BOKWR.52.1.A01.1.454.heavy.3.raw
cgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtgactccatcagcagtggttattactgggcctgggtccggcagcccccagggaaggggtttgagtggattgggagtatcgatcacagtgggagcacctacctgaacccgtccctcacgactcgagtcgccatatcaacagacacgtccaagaaccagttctacctgaggctgaactctgtgaccgccgcagacacggcccgtatattattgtgcgcgggacttcagggtggatatagtggctacgattcgtatctccttgactactaggggccagggaaccctggtcaccgtct

SEQ ID NO: 528505 - DNA, 492 bp, Homo sapiens
  misc_feature: HEFZJCU01BFOA3.13.86.H09.1.454.heavy.3.raw
  modified_base (478)..(478): a, c, t, g, unknown or other
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaacacagactatggacagaacctccagggcagattcaccatgacgacagacacatacacgaacacagcctacatggaggtgaggagcctgagatatgacgacgacggccgtgtattattgtgcgagagtggagtggcagtggatancgacaaattactta

SEQ ID NO: 528506 - DNA, 505 bp, Homo sapiens
  misc_feature: HEFZJCU01CINK5.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtactaatttgataggactctatggactggaccttcgtc

SEQ ID NO: 528507 - DNA, 495 bp, Homo sapiens
  misc_feature: HEFZJCU01DTZI3.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttc

SEQ ID NO: 528508 - DNA, 518 bp, Homo sapiens
  misc_feature: HEFZJCU01DVRC0.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttgggagtcagggaactctgtcaccgtctcctcagcctccaccaacgggcccatcggtcttcccctggccgccctgctccaggacgcacctccgagagcacagcggccctgggctcg

SEQ ID NO: 528509 - DNA, 545 bp, Homo sapiens
  misc_feature: HEFZJCU01C1DZH.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatcggacccttcgtgggacaccagccacactatttctgtgcacactactataggagcacctggtagtctgccaactggttacgacccctgggggcccgggaacctcggtcaccgtctcctctacgcctccaccaacgggccatcggtccttcccctc

SEQ ID NO: 528510 - DNA, 547 bp, Homo sapiens
  misc_feature: HEFZJCU01CKY5E.48.40.D07.1.454.heavy.3.raw
agtatacatacacgaccggtgctcgatttagtgatagagcgtaacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgagaggcggaggacaccggcgcttttatatttgtacaacgttcgttttacttttcttaatggtggctcttacgaacgacatgactatgggggtcggggaacctggtacg

SEQ ID NO: 528511 - DNA, 549 bp, Homo sapiens
  misc_feature: HEFZJCU01EY4G0.17.28.C06.1.454.heavy.3.raw
  modified_base (476)..(476): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccaggggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattacngtgcgagatgtaggaaaaagtaatggctgtgttttagttgggggcctaggggacgcccctgggtcctacccgg

SEQ ID NO: 528512 - DNA, 512 bp, Homo sapiens
  misc_feature: HEFZJCU01AW8G7.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccactcgccacaacttacatggaactgaccagtactgacatttgacgacacggccgtctattactgtgcgacagaagcggcggacagaggttcgcttactggttcgaggctctccccacg

SEQ ID NO: 528513 - DNA, 478 bp, Homo sapiens
  misc_feature: HEFZJCU01CMX8Z.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaagtatgcacagaagtttcgagggcagggtcaccatgaccagggacacgtccatcagcacgtccatcagcacagcctacatggacctgagcggcctgacatctgacgacacggccgtatattctgtgcgaggg

SEQ ID NO: 528514 - DNA, 501 bp, Homo sapiens
  misc_feature: HEFZJCU01DT8VO.17.10.A10.1.454.heavy.3.raw
  modified_base (459)..(459): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggacttggacttctc

SEQ ID NO: 528515 - DNA, 529 bp, Homo sapiens
  misc_feature: HEFZJCU01DCI3C.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacacgacttaccatgaccacgaactcctccataaacacagcctacatggagttgaggagcctgacatctgacgacacgggccgttctattactggtgcgtagacgtcccacgacgtccgggtagacgtcccgtaccgggcacggccgggtcccttttgacgtttctc

SEQ ID NO: 528516 - DNA, 560 bp, Homo sapiens
  misc_feature: HEFZJCU01EO4LQ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgaagaccagacgacacggctgtctattattgcgcgagagagacacacgaacctactcggaccaatactagtgggggcttgttgtcgggggccgacgggggaccctgggtcagttcggtccttcccccaggccctccctaacccgaacggggtccccaacgtccgggttccttcccccgtcggtccg

SEQ ID NO: 528517 - DNA, 505 bp, Homo sapiens
  misc_feature: HEFZJCU01ANM4M.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataacacagcctacatggagttgaggagcctgacatctgacgacacggccgtctattactgtgcgagagtcccagactccggtgagcctacggcagccggcctttgactttcgtc

SEQ ID NO: 528518 - DNA, 526 bp, Homo sapiens
  misc_feature: HEFZJCU01A61RP.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtccaccgtctcctcagcctccacc

SEQ ID NO: 528519 - DNA, 489 bp, Homo sapiens
  misc_feature: HEFZJCU01C7LKW.48.27.C05.1.454.heavy.3.raw
agtatacatacacgaccggtgctcgatttagacgcgatcgaagggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctgggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagaataatcggctagaataaagatatac

SEQ ID NO: 528520 - DNA, 517 bp, Homo sapiens
  misc_feature: HEFZJCU01A32UX.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagcctccaggcaagggattggagtgggtggcagttgtttcatctgagggcagtgttcaatggtatgcagactccgtgaagggccgattcaccatctccagagacaattccaggaacacaatgtatttggagctgaacagacctaagtcctgaggacgacgggcgtatactactgtacgaagggaggggggaaccaggcggagttccaagtactcttgtacg

SEQ ID NO: 528521 - DNA, 514 bp, Homo sapiens
  misc_feature: HEFZJCU01EA4Q1.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccaacaaaccaggtggtccttaacaatgaccaatatggaccctgtggacacagccacatattactgttcacgctctatggttcggggagttattagtccctactttgactactggggccagggaactctggtcaccgtctccgcagcctccaccagggccc

SEQ ID NO: 528522 - DNA, 535 bp, Homo sapiens
  misc_feature: HEFZJCU01ASZ2Y.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaaacagcctgagagccgaggacacggctgtgtattattgtgcgaagggcaggtggctgggacatggacgtcgtggggccaagggacccacggtcaccgt

SEQ ID NO: 528523 - DNA, 497 bp, Homo sapiens
  misc_feature: HEFZJCU01DA04P.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggttcgggtattagtgctcttgatgatagcacatactatgcagactccgttaagggccgcttcaccatctccagagacaattcaagaacacgctatatctgcagatgaacagcctgggagccgaggacacgggccgttttatcactgtgcgtaagatatttgtaatga

SEQ ID NO: 528524 - DNA, 520 bp, Homo sapiens
  misc_feature: HEFZJCU01A0R62.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacgggcctatattactgtgcgagaataacccgttcgcctggttattacc

SEQ ID NO: 528525 - DNA, 524 bp, Homo sapiens
  misc_feature: HEFZJCU01E0WF6.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacggtggcaactcctatgcttttgatatctggggcaagggacaatgtcaccgtctcttcagcctccaccaacgggcccatcggtccttcccctggccaccctccctccaacgagacctacctcgtcgggggctacgagccggccc

SEQ ID NO: 528526 - DNA, 522 bp, Homo sapiens
  misc_feature: HEFZJCU01DGC1S.12.40.D07.1.454.heavy.3.raw
  modified_base (506)..(506): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacaccgaacctactggccaatactatgggggcttggttctggggccagggggaccctggtcatcgtctccccagcctccaccaaggccancggtcttcccctgccg

SEQ ID NO: 528527 - DNA, 515 bp, Homo sapiens
  misc_feature: HEFZJCU01E09TU.26.12.B01.1.454.heavy.3.raw
agactatactcacgaccggtgctcgatttagtagtgtagattccgcggggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgaggacacggcttttatttctgtgcaaaggtggaaccgacatatttcacaagctggcactggtacttcg

SEQ ID NO: 528528 - DNA, 504 bp, Homo sapiens
  misc_feature: HEFZJCU01CJSX4.4.81.H04.1.454.heavy.3.raw
  modified_base (484)..(484): a, c, t, g, unknown or other
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgttctgcaatgaacagcctgagagtcgaggactcggctgtctactactagtgcgaggaataggganctaccctacgatttggacac

SEQ ID NO: 528529 - DNA, 543 bp, Homo sapiens
  misc_feature: HEFZJCU01A98N4.48.81.H04.1.454.heavy.3.raw
agtatacatacacgaccggtgctcgatttagtagtgtagattcgcgggaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatcccttctctaatgtcacaagatacacacagagattccagggcagaatcacacttaccgcggacaaatccgacgggcacagcgcagttggacctgagcggcctgagaccgtgaggacacggccatttactactgtgtcggcggggaggtgggacggagcgtcggtttttcgggagtttagtctatctactaactttgtaatcgttcgggggcccgggaacccgtcggtccgtaccg

SEQ ID NO: 528530 - DNA, 514 bp, Homo sapiens
  misc_feature: HEFZJCU01E1FS7.49.12.B01.1.454.heavy.3.raw
agtcgagagacacgaccggtgctcgatttagtagtgtagatttgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtgggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaaacagcctgagagctgaggacacggcttatttattactgtgacgaacttaatcacggaggacaaggggtgacccccgt

SEQ ID NO: 528531 - DNA, 517 bp, Homo sapiens
  misc_feature: HEFZJCU01BY6T2.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgattgcctttcggtccggcgggacttcgtggggccagggtaaccccg

SEQ ID NO: 528532 - DNA, 518 bp, Homo sapiens
  misc_feature: HEFZJCU01A6L9A.8.34.D01.1.454.heavy.3.raw
ctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggcgattcaccatctccagagacaattccaggaacacaatgtatttggagctgaacagcctaagtcctgaggacacgggcgtatactactgtacgaagggaggggggaaccgagacggggagttccgaagtact

SEQ ID NO: 528533 - DNA, 508 bp, Homo sapiens
  misc_feature: HEFZJCU01DHVOF.4.58.F03.1.454.heavy.3.raw
  modified_base (486)..(486): a, c, t, g, unknown or other
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaaccattaaccagggacacatccgcgaacacagcctacatggagctgagcagcctgacatctgaagacacggctgtgtattactgttcgagacgggctagtctgggatctagtttatagtnacttcgtcgtttcgtggggccg

SEQ ID NO: 528534 - DNA, 487 bp, Homo sapiens
  misc_feature: HEFZJCU01DT5D8.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaaatacaaattatgcaccatctgttgagagtcgactgacaatacaacgtagacacatacgaagaaccagttctccctgcagctgacctctgtgactcccgaggacgacgggtgtatattactgtggaagacggccccatacg

SEQ ID NO: 528535 - DNA, 492 bp, Homo sapiens
  misc_feature: HEFZJCU01CSMSB.48.71.G05.1.454.heavy.3.raw
  modified_base (460)..(460): a, c, t, g, unknown or other
agtatacatacacgaccggtgctcgatttagtgtcgtcgcaagagagagggggggcatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccaggcctgaagtctgaagacacgggcatatattctgtncgacagatggtcgtggattctcgtctgcttat

SEQ ID NO: 528536 - DNA, 532 bp, Homo sapiens
  misc_feature: HEFZJCU01DMGJV.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgactttggggccagggaaccctggtcaccgtctcctcagcctccaccaagggcccatcggtcttccccctggcaccctcctccaagacgcacctctgggggcacagcggccctgggctgcct

SEQ ID NO: 528537 - DNA, 527 bp, Homo sapiens
  misc_feature: HEFZJCU01AQGQP.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcttttacacctccttcgacttctggggccatggaacccggtccg

SEQ ID NO: 528538 - DNA, 508 bp, Homo sapiens
  misc_feature: HEFZJCU01DHBDC.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagacgcacctctgggggcacgagcggccctgggctgcctggtcaaggactacttccgagtagtaca

SEQ ID NO: 528539 - DNA, 524 bp, Homo sapiens
  misc_feature: HEFZJCU01C4FST.19.67.G01.1.454.heavy.3.raw
tactctcgtgcacgaccggtgctcgatttagagtatacatattgggtttgggggggaggaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctctttcaaatgaaacagcctgagggcccgagggacacgggccgtctattattgtgtgagagtttatggcgatgggctgggtggacagatcactgggggccaac

SEQ ID NO: 528540 - DNA, 497 bp, Homo sapiens
  misc_feature: HEFZJCU01B6KA7.5.41.D08.1.454.heavy.3.raw
  modified_base (375)..(375): a, c, t, g, unknown or other
  modified_base (485)..(485): a, c, t, g, unknown or other
atcagacacgcacgaccggtgctcgatttagtcacgcgagaaagggaaagggggcatcacataacaaccagattcctcctctaaagaagcccctgggagcacagctcatcaccatggactggacctggaggttcctctttgtggtggcagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggccctgggcagggacttgagtggctggggcggatcatccctaccgttgatgtggcaaactatgcacagaagttccagggcagagtcanaattaccgcggacaagtccgcgagcacagctacatggagctgaacaacctgagatctgaagacacggccgtctattactgtacgacctgcgctacggtgactaccgctcngcttcgggccta

SEQ ID NO: 528541 - DNA, 543 bp, Homo sapiens
  misc_feature: HEFZJCU01EIH5V.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctgggggcccgggaacccgtggtcaccgtctcctcacgcctccaccaagggcccagtcggtcttccccctggccaccctcctaccaagacg

SEQ ID NO: 528542 - DNA, 508 bp, Homo sapiens
  misc_feature: HEFZJCU01DLC3T.10.38.D05.1.454.heavy.3.raw
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccaccgtattattgtgcgcgacatgactacgctcaattctggggccagggacg

SEQ ID NO: 528543 - DNA, 484 bp, Homo sapiens
  misc_feature: HEFZJCU01CSBS1.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatcctccagagacaattccaagaacacgctgtatctgcaatgaacagcctgagagctgaggacacggctgtgtattactgtgcgaggcggt

SEQ ID NO: 528544 - DNA, 484 bp, Homo sapiens
  misc_feature: HEFZJCU01BNIJF.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctcaggcaagggctggagtgggtggcagttatatcatatgatgggaagtaataaatactatgcagactccgtgaagggccgattcaccatctccagagacaattccaagaacacgctgtatctgcaaatgaacagcctgagagctgaggacacggctgtgtattactgtgcggaggcggt

SEQ ID NO: 528545 - DNA, 533 bp, Homo sapiens
  misc_feature: HEFZJCU01DP5FY.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttattcatatgatggaactactcaacactatccagactccggggagggccgattcaccgtctccagagacaattccaagaacaggggtgtttctaccaagtgattgatctgagaagtgaaggacacggctgttattactgtgcgcggtggctgaccgctcttgactacgtgggggccggggaggtcccggtcatccgtctccg

SEQ ID NO: 528546 - DNA, 495 bp, Homo sapiens
  misc_feature: HEFZJCU01AVJ99.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactggtgggagagatggaggtcgatattgta

SEQ ID NO: 528547 - DNA, 530 bp, Homo sapiens
  misc_feature: HEFZJCU01ERWKP.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggtttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacggggtgtatactactgttacgaagggacggggggaaccgaggacgggagttaccgaagtaccttaccg

SEQ ID NO: 528548 - DNA, 535 bp, Homo sapiens
  misc_feature: HEFZJCU01ESJ8Q.52.5.A05.1.454.heavy.3.raw
cgcagtacgacacgaccggtgctcgatttagatagatagacagggggctctgggaaaggagccccagccctgagattcccaggtgtttccattcggtgatcagcactgaacacagaactcaccatggagtttggactgagctgggttttccttgttgctattttaaaaggtgtccaggctgaagtgcagctggtggaatctgggggaatcgtggtgcggcctggggggtccctgagactctcctgttcagccgctggattcacgtttgatgattatgccatgtactgggtccgtcaagctccggggaaggtctggagtgggtctctcttgtgaattgggatggcagtgcttcttattacgccgactctgtgaagggtcgttcaccatctcagagacaacagaaaaactccctatatcttacaaatgagaagtctgagaattgaggacaccgccttaatattaactgcgctaaaggtccttgacgcgttggctataaatggtattggacctacgtaggggccgagggaacccgtac

SEQ ID NO: 528549 - DNA, 514 bp, Homo sapiens
  misc_feature: HEFZJCU01BJXMH.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggcctccagggaaggggctggaatgggtctcaggtattactggtggtggttataccacatactacgcagactccgtgaaggggccggttcaccatcctccagagacaattccaagacacactgtatctgcaaatgaacagcctgagagccgacgacacggccatatattactgtgacgaaagcaccggcagttagtcacccatactactttgactactggggccac

SEQ ID NO: 528550 - DNA, 502 bp, Homo sapiens
  misc_feature: HEFZJCU01BZLDX.48.28.C06.1.454.heavy.3.raw
  modified_base (489)..(489): a, c, t, g, unknown or other
agtatacatacacgaccggtgctcgatttagagctcacgtattgggtttgggggattcccaggtgtttccattcagtgatcagcactgaacacagaggactcaccatggagttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaagatcaggcattagacttacaacggtatggacgtntcggggccaaggg

SEQ ID NO: 528551 - DNA, 501 bp, Homo sapiens
  misc_feature: HEFZJCU01DAXQ6.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctaccaaaaacccaggtggtccttacaatgaccaacatggaccctgtggacacagccacatattaactgtgcacagagatacgggcagcacgtgggtttggggctacgtggggccagggaaccctggtcaccgtctcctcagcctccaccg

SEQ ID NO: 528552 - DNA, 514 bp, Homo sapiens
  misc_feature: HEFZJCU01BZODJ.4.39.D06.1.454.heavy.3.raw
agcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaaggcccatcggtcttcccctggcgccctgctccaggagcacctccgagagcacagcggccctgggctgcctggtcaaggacttacc

SEQ ID NO: 528553 - DNA, 538 bp, Homo sapiens
  misc_feature: HEFZJCU01EAFE1.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgtttgtttgtttggccggtgaactactgggccagggcaccctggtcaccgtctcctcagcttccaccaacgggcccatcggtccttcccctggccgccctgcctccaggacgcacctcgtcgggggcacgaggcggcccgtggggccttcggccgtcggtcaaggtactaacctttccccaacttaccg

SEQ ID NO: 528554 - DNA, 527 bp, Homo sapiens
  misc_feature: HEFZJCU01DSUU0.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaactccaggtaaggggttggtgtgggtctcacgtatcaatcctgatggcagtgttataaattatgcggactccgtgaggggccgattcagcatctccagagacaacggcaagagtatactgtatctggaaatagaacaatctgagagtcgacgatacggctgtctatcattgtgttttcgatgcctttcggtccggcggggtaccttcgtcggggccgaggggaacccgtgggtccg

SEQ ID NO: 528555 - DNA, 529 bp, Homo sapiens
  misc_feature: HEFZJCU01CB23G.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccattcattaaacacgtctaagaaccagttctccctgaagctgacctttgtgactgccgcggacacggccgtgtattactgtgcgagagcccctcgatagcagtggctgggtccacgttaggtttgactacgtgggggcccaggggaacgctttggtccaccgttctcctcagccta

SEQ ID NO: 528556 - DNA, 528 bp, Homo sapiens
  misc_feature: HEFZJCU01ELDZW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactaatgggggcttgttctgggggccgaggggaccctggtcatcgttctccccagcctccaccaagggcccatcgtcttcccctgcgcctcg

SEQ ID NO: 528557 - DNA, 517 bp, Homo sapiens
  misc_feature: HEFZJCU01EZ0LS.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacaggccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgccgcgaaggatagtacgggtcgacgaacggtggctacgcgtttctag

SEQ ID NO: 528558 - DNA, 493 bp, Homo sapiens
  misc_feature: HEFZJCU01DM44E.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcgcccgtcgggctgcctggtcaaggactacttccgtattctctcg

SEQ ID NO: 528559 - DNA, 502 bp, Homo sapiens
  misc_feature: HEFZJCU01BVZCR.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataggactgagatctgacgacacggccgtatattactgtgcgttattaacggacgattacgatgttttgattggttttta

SEQ ID NO: 528560 - DNA, 526 bp, Homo sapiens
  misc_feature: HEFZJCU01BEV77.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgcccaagaatgcgatatatctacagatgaacagcctgcgagccgaggacacggctgtgtattactgtgggagtccctggctggcacctgtatccgaccgttggagtcagggaactctggtcaccgttctcctcagcctccaccaagggcccatcggtcttccccctggccgcccgtgcctccaggacgcaccctccgagagccacagcggcccgtggggctc

SEQ ID NO: 528561 - DNA, 527 bp, Homo sapiens
  misc_feature: HEFZJCU01E00JY.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcggagcaccaactacaacccgtccctcaagagtcgagttaccatttcattaaacacgtctaagaaccagttctccctgaagctgacctttgtgactgccgcggacaccggccgtgtattactgtgcgagacgacccctccgactagcagtggctcgggtccactaggtttgacgtactgggggccagggaagcgttggtcaccgtctcctcagcct

SEQ ID NO: 528562 - DNA, 531 bp, Homo sapiens
  misc_feature: HEFZJCU01EFW7A.48.75.G09.1.454.heavy.3.raw
  modified_base (506)..(506): a, c, t, g, unknown or other
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacaccctccaaaaacaggtggtccttaaaatagaccaacatggacccaatggacagcgcgacatattactgtgcacacattgattgtggtcccaccaggtcgtcccgggcccgtttcgagtatcttcggggccggggggaccgagttccgtactccgtcctctgcngcctcccacccaacgggaccctacg

SEQ ID NO: 528563 - DNA, 489 bp, Homo sapiens
  misc_feature: HEFZJCU01BER4A.11.38.D05.1.454.heavy.3.raw
cgagagataccacgaccggtgctcgatttagtatctgatagttgggtttggggaggcttggtacagcctggggggtccctgagactctcctgtgcagcgtctggattcacctttagcaagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactgggccagggaaccctggtcaccgtctcctcagcctccaccaagggcccatcggtcttccccctggctaccctcctccagagcacctctgggggcacagcgccctgggctgcctggtcaaggactacttcgtatctctcg

SEQ ID NO: 528564 - DNA, 509 bp, Homo sapiens
  misc_feature: HEFZJCU01A9CRX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttggatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagagtgggggcccacgaacgtttactacgcgtatggacgttcgt

SEQ ID NO: 528565 - DNA, 490 bp, Homo sapiens
  misc_feature: HEFZJCU01E15D5.19.13.B02.1.454.heavy.3.raw
  modified_base (402)..(402): a, c, t, g, unknown or other
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagngacaattccaagaacacgctgtatctgcaaatgaacagcctgagagctggaggacacggctgtgtattactgtgcgagggcggttacg

SEQ ID NO: 528566 - DNA, 502 bp, Homo sapiens
  misc_feature: HEFZJCU01A5736.48.68.G02.1.454.heavy.3.raw
agtatacatacacgaccggtgctcgatttagtcgatagtgaagggaaaggggctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttcggggtac

SEQ ID NO: 528567 - DNA, 506 bp, Homo sapiens
  misc_feature: HEFZJCU01CPCGD.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggcaccctcctccagagcacctctgggggcacagcggccctgggctgcctggtcaaggactacttccgagtagtaca

SEQ ID NO: 528568 - DNA, 378 bp, Homo sapiens; identical to SEQ ID NO: 449902
  misc_feature: HEFZJCU01BZV6M.47.77.G11.1.454.heavy.3.raw

SEQ ID NO: 528569 - DNA, 513 bp, Homo sapiens
  misc_feature: HEFZJCU01DRL8K.40.81.H04.1.454.heavy.3.raw
tctagcgactcacgaccggtgctcgatttagtagtgtagattcgcggggacacatctgtcctctagagaatcccctgagagctccgttcctcaccatggactggacctggaggatcctcttcttggtggcagcagccgcaggagcccactcccaggtgcagctggtacagtctggggctgaggtgaagaagcctggggcctcggtgaaggtctcctgcaagatttctggaaacaccctgagcaactactacatacactggatgcggcaggcccctggacaggggtttgagtggatgggggtggatcaaccctaccagaggtggcacaaagtatcgacagaactttcagggcagggtcaccatgacctgggacgcgtccatcagcacagtctacatggatctgagcggactgacctctcgacgacacggccatgtattactgtaggagagacgttggtggctaccggcggggctgaccactggggccaggggaaccctggtcaccgtctcctcg

SEQ ID NO: 528570 - DNA, 535 bp, Homo sapiens
  misc_feature: HEFZJCU01DTRN2.17.28.C06.1.454.heavy.3.raw
  modified_base (502)..(502): a, c, t, g, unknown or other
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagttagttattggatgacttgggtccgccagactccagggaaggggctggagtgggtggccaacataaagcaagatggaactgccgagttttacgtggactctgtgaagggccgtttcaccatctccagagacaacgccaagaatcactgtatctacaactgaacagcctgagagtcgcagacacgccgtgtatactgtgcgagatgtagaaaagtaatggctgtntttagttgggccaggggacnccgtggtctaccg

SEQ ID NO: 528571 - DNA, 519 bp, Homo sapiens
  misc_feature: HEFZJCU01CP4BG.48.34.D01.1.454.heavy.3.raw
agtatacatacacgaccggtgctcgatttagatcgtctgtgttgggtttgggcacgaccggtgctcgatttagatcgtctgtgttgggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcgacctccgagacgcacagcggcccgtcgggtccg

SEQ ID NO: 528572 - DNA, 529 bp, Homo sapiens
  misc_feature: HEFZJCU01B5WKM.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcacccttgaccacagacacataccgcgaacacagcctacatggaactgaggaatctgacatctgacgacacggccatatattactgtgcgagaaggacggttttggggcgcggactcctcttgagattctggggcccagggggacaagtggtcaccgtctctttcacgt

SEQ ID NO: 528573 - DNA, 506 bp, Homo sapiens
  misc_feature: HEFZJCU01C8QJA.51.59.F04.1.454.heavy.3.raw
cgatcgtatacacgaccggtgctcgatttagtacacacacttagggattggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccagggctgggaggtccctgagactctcctgtgcagcctctggattcaccttcagtacccatgaaatgcactgggtccgccaggctccgaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgaattacagcagccctac

SEQ ID NO: 528574 - DNA, 533 bp, Homo sapiens
  misc_feature: HEFZJCU01AECHJ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgaccttctggggccagtcggaaccccggtaccg

SEQ ID NO: 528575 - DNA, 539 bp, Homo sapiens
  misc_feature: HEFZJCU01C5RCZ.16.86.H09.1.454.heavy.3.raw
  modified_base (394)..(394): a, c, t, g, unknown or other
  modified_base (415)..(415): a, c, t, g, unknown or other
  modified_base (506)..(506): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatcccgccagcacccagggaagggcctggagtggattgggaacatctattacagcgggagcaccaactacaacccgtccctcaagagtcgagttaccatttcattaaacacgtctaagaaccagttctccctgaanctagacctttgtgactgccgnggacacggccgtgtattactgtgcgagacgacccctcgatagcagtggctcgggtccacgttaggtttgacttacgtggggccaggggaancgtttggtcacccggtctcctcgacgcctcccg

SEQ ID NO: 528576 - DNA, 518 bp, Homo sapiens
  misc_feature: HEFZJCU01CRBHA.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgaccctggggccagggaaccctagtccaccgtcctcctcagcctccaccaagggccccagtccggttcttcccccgtggccgtccctcgcctccaaggcgctaccctccgacgacgg

SEQ ID NO: 528577 - DNA, 523 bp, Homo sapiens
  misc_feature: HEFZJCU01AZUPA.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacgacgggcgtatactactgtacgaagggaaggggggaaccgaggcgggagttccaagtactcctttgacgtcgtc

SEQ ID NO: 528578 - DNA, 510 bp, Homo sapiens
  misc_feature: HEFZJCU01CL4L1.12.14.B03.1.454.heavy.3.raw
atacgacgtacacgaccggtgctcgatttagtgtgagtagtttgagtttggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggcccagggaaccctggtcaccgtctcctcagcctccaccaagggcccatcggtcttccccctggcaccctcctccaagagcacctcctgggggcacagcggccctgggctgcctggtcaggactactccttacgtcgtat

SEQ ID NO: 528579 - DNA, 541 bp, Homo sapiens
  misc_feature: HEFZJCU01AHXDP.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccactaactggctcggccctcgggcccgggaaccctggtcaccgtctcctcagcctccaccaggcccatcggtccttccccctcggccacccgtccctccaacgacg

SEQ ID NO: 528580 - DNA, 515 bp, Homo sapiens
  misc_feature: HEFZJCU01DGKRT.40.55.E11.1.454.heavy.3.raw
  modified_base (504)..(504): a, c, t, g, unknown or other
tctagcgactcacgaccggtgctcgatttagcactcgcacgttgggtttgggggctttctgagagtcatggatctcatgtgcaagaaaatgaagcacctgtggttcttcctcctgctggtggcggctcccagatgggtcctgtcccagctgcagctgcaggggtcgggcccaggactggtgaagccttcggagaccctgtccctcacctgcactgtctctggtggctccatcagcagcagtacttacttctggggctggatccgccagcccccagggaagggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgttttatccctggggccagggaaccctggtcaccgtctcctcancctccaccaac

SEQ ID NO: 528581 - DNA, 527 bp, Homo sapiens
  misc_feature: HEFZJCU01D6SUS.17.34.D01.1.454.heavy.3.raw
  modified_base (481)..(481): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactnctccttttacacctcccttgacttctggggccagtggaaccccggt

SEQ ID NO: 528582 - DNA, 493 bp, Homo sapiens
  misc_feature: HEFZJCU01B69U1.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccaggggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggttatttcgatctctggggccgtggcaccctggtcactgtctcctcggcttccaccaaggcccatcggtcttcccctgcgcctgctccagagcactc

SEQ ID NO: 528583 - DNA, 511 bp, Homo sapiens
  misc_feature: HEFZJCU01A5904.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacaggaactttcaggacagggtcaccatgaccacggacacgtccatcaacacagccacatggaactgaggagcctaagatctgacgtacacggccgtttatttattgttgcaataagaaattgacaaacgtaatgcgttttgtataatggtggggtacc

SEQ ID NO: 528584 - DNA, 559 bp, Homo sapiens
  misc_feature: HEFZJCU01D1H1L.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacaggccggggggtccctgagactctcctgtgcagcctctggattcaattttaacagctttgccatgggctgggtccgccaggctccaggggaaggggctggagtgggtctcgaatattaatgaaagggggtgagtaacacatactatgcggactctggtaaggggccggttcacccatctccagacgacaattccaagaaacactgtatctgcaattaaccagcctgagagtcgaggacacggccctttattactgtcgcgaaggatcgccctatatggtggcgtggagtcgggggagttttggttccgttgggggcccagggggaaccccttgggtcccg

SEQ ID NO: 528585 - DNA, 501 bp, Homo sapiens
  misc_feature: HEFZJCU01EU120.3.63.F08.1.454.heavy.3.raw
  modified_base (396)..(396): a, c, t, g, unknown or other
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagngacaacgccaagaactcactgtatctgcaaatgaacagcctgagagccgaggacacggctgtgtattactgtgcgagtttgtttgggcgggatagcagcggtacc

SEQ ID NO: 528586 - DNA, 339 bp, Homo sapiens
  misc_feature: HEFZJCU01EHWCS.51.37.D04.1.454.heavy.3.raw
cgatcgtatacacgaccggtgctcgatttagtagcatactgttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattcgggacacactgtctctgc

SEQ ID NO: 528587 - DNA, 530 bp, Homo sapiens
  misc_feature: HEFZJCU01CNU04.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctcccacaaacccaggtggtccttacaatgacccaatatggaccctgtggacacagccacatattactgttcacgctctatggttcggggagttattagtccctactttgtactactggggccaggggaactctggtcaccgtctccgcagcctccaccaagggcccatcggtcttccccttcggcaccctcctccaagagcacctctgggggcacagcggcctcgggctgcctggtc

SEQ ID NO: 528588 - DNA, 531 bp, Homo sapiens
  misc_feature: HEFZJCU01BV3UD.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgccttgcctcttgactactggggccaggaaccctggtcaccgtctcctcagcctccaccaagggcccatcgtcttccccctggcaccctcctcccaagagcacctcctggggggcacagcggccctggggctgcctggtcaaggactacgttccg

SEQ ID NO: 528589 - DNA, 515 bp, Homo sapiens
  misc_feature: HEFZJCU01D3Y28.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcgggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaagacctcttatttttggccgtcggccgactacgtggggccgac

SEQ ID NO: 528590 - DNA, 545 bp, Homo sapiens
  misc_feature: HEFZJCU01DD5XM.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctggggcccgggaaccctcggtcaccgtctcctcagcctccaccaacgggcccatcggtccttccccctcggccaccctccctcccaacgacg

SEQ ID NO: 528591 - DNA, 379 bp, Homo sapiens
  misc_feature: HEFZJCU01CF3T6.19.17.B06.1.454.heavy.3.raw
tactctcgtgcacgaccggtgctcgatttagtcgatagtgaaggggctggaatggcttgcatcccttggttggagtggaattaatacacaccacgcagactcagtgaggggccggttcaccatctccagagacaacgccaagagtacaatgtatttacaaaatgaacagcctgagagccgaggatacggctgtgtattattgtgcgagaatttccgagccgcactactttgactactggggccagggagccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 528592 - DNA, 524 bp, Homo sapiens
  misc_feature: HEFZJCU01CPT6Z.9.33.C11.1.454.heavy.3.raw
tgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtactactttgactttcgg

SEQ ID NO: 528593 - DNA, 526 bp, Homo sapiens
  misc_feature: HEFZJCU01DNV1W.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctcctcaagagtcgagtcaccatatcaatagacacgtcgaagaaccagttctccctgaagttgaactcagtgaccgctgcggacacggccgtgtattactgtgcgagccacaccgattacgtattttggagtggccttgataacgtggggccgaggggatccgtggtcgaccgtcctcctcagcctccacc

SEQ ID NO: 528594 - DNA, 521 bp, Homo sapiens
  misc_feature: HEFZJCU01C6SRV.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaatagacagcctgagaccagacgacacggctgtctattattgcgcgagagagacgacacgaacctactggccaatactatgggggcttgttctgggggccaggggaccctggtcatctctccccagcctccaccaaggcccatcggtcttcccctggccg

SEQ ID NO: 528595 - DNA, 533 bp, Homo sapiens
  misc_feature: HEFZJCU01BCBB7.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatagcccaggccttcacagggcggtttgtcttctccatggatacctctgtcgggacggcgttatctgcagataaccaaccttcaacctgacgacactgccgtttattttgtacgagagcgtcgtctgtcagtggaattgactactggggccagggaaccctggtcaccgtctcctcagcctccaccaaggg

SEQ ID NO: 528596 - DNA, 534 bp, Homo sapiens
  misc_feature: HEFZJCU01CRB5U.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagcctatgccatgacctgggtccgccaggctccagggaaggggctggaatgggtctcaggtattacgtggtggtggttataccacatactacgcagactccgtgaagggccggttcaccatctccagagacaattccaagaacacactgtatctgcaaatgaacagcctgagagccgacgacacggccatatatttactggtgtacgaaagcgacccggctaaggttacgtccaccctataccttaacttttgacttacgtgggggaccaac

SEQ ID NO: 528597 - DNA, 526 bp, Homo sapiens
  misc_feature: HEFZJCU01EAG3O.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctccttttacacctccttgacttctgggccatggaaccccggtcaccgt

SEQ ID NO: 528598 - DNA, 516 bp, Homo sapiens
  misc_feature: HEFZJCU01B3Z9H.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtaccagtgtgaggtgcaggtagtggagtccgggggaggcttaggttcagcctggggagtccctggagacctctcctgtgtagtctctggaatcagtttcagtaccttctggatgcactgggtccgccaaactccaggtaaggggctggtgtgggtctcacgtatcaagtcctgatggcagtgttataaattatgcggactccgtgaggggccgattcagcatctccagagacaacggcaagagtatactgtatctggaaatgaacaatctgagagtcgagatacggctgtctatcattgtgttttcgatgccttcggtccgcgggacttctggggccagggtaaccctc

SEQ ID NO: 528599 - DNA, 521 bp, Homo sapiens
  misc_feature: HEFZJCU01ER72O.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatcctccagagacaacttccaagaacacgctgtttcttcaaatgaacagcctgagagccgatgacacggccgtgtattactgtgcgagagagtgggcccacgaacgttactacgctatggacgtcgtgggccaagggtaccg

SEQ ID NO: 528600 - DNA, 516 bp, Homo sapiens
  misc_feature: HEFZJCU01DL3GE.15.23.C01.1.454.heavy.3.raw
  modified_base (508)..(508): a, c, t, g, unknown or other
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacgggcccgtgtattactgtgtgagagacatgaacacggtgataaccggnggggttag

SEQ ID NO: 528601 - DNA, 514 bp, Homo sapiens
  misc_feature: HEFZJCU01DURAB.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgttggcgaggagatgggggccccacgaacgttactacgctatggacgtc

SEQ ID NO: 528602 - DNA, 497 bp, Homo sapiens
  misc_feature: HEFZJCU01B52IQ.14.55.E11.1.454.heavy.3.raw
  modified_base (298)..(298): a, c, t, g, unknown or other
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccnccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagagtgggagggggtggtg

SEQ ID NO: 528603 - DNA, 518 bp, Homo sapiens
  misc_feature: HEFZJCU01CAA97.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagtcttttgtatctctggggccaagggacacgtggtcaccgtctcttcagcctccaccaacgggcccactcggttccttccccctcggccgccctcgctccaggacg

SEQ ID NO: 528604 - DNA, 518 bp, Homo sapiens; identical to SEQ ID NO: 449255
  misc_feature: HEFZJCU01BFEEN.3.17.B06.1.454.heavy.3.raw

SEQ ID NO: 528605 - DNA, 491 bp, Homo sapiens
  misc_feature: HEFZJCU01C9XBX.40.1.A01.1.454.heavy.3.raw
tctagcgactcacgaccggtgctcgatttagacgtctcatcaggggagctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcattttcagtaactatgctatgcactgggtccgccagactccgggcaaggggctggagtgggtggcaattatctcatatgatgaaagtcaagaatactacgcagactccgtgaaggcgatcacatctccagagacaattccaagaacacactgaatctacaaatgaacagcctcagacctgaggactcggctgtctatttctgtgcgagaggggggtgacgtatcgatt

SEQ ID NO: 528606 - DNA, 560 bp, Homo sapiens
  misc_feature: HEFZJCU01ER37W.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaatgaacagcctagaaaaccgaggacgacggccgtgtattacttgtactagacgaggtaggtattactagtttggggggtagtttagtcggtacggaaacgggggggtacgtacgtaccgtacg

SEQ ID NO: 528607 - DNA, 514 bp, Homo sapiens
  misc_feature: HEFZJCU01CQG3C.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccaggggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaagacctctattttgggccgcggccgactacgtggggccac

SEQ ID NO: 528608 - DNA, 494 bp, Homo sapiens
  misc_feature: HEFZJCU01BVUUK.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcgaagggccgattcaccatctccagagacaattccaagaacatggtgtatctgcaaatgaccagcctgagagccgaggacacgggtgtttaattacgtgtgggaagaaatccta

SEQ ID NO: 528609 - DNA, 540 bp, Homo sapiens
  misc_feature: HEFZJCU01CA900.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgttgtttagttgggggtccaggggacgcccgtggtcaccgtt

SEQ ID NO: 528610 - DNA, 477 bp, Homo sapiens
  misc_feature: HEFZJCU01D9UYL.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatattctgtgcgaggg

SEQ ID NO: 528611 - DNA, 485 bp, Homo sapiens
  misc_feature: HEFZJCU01A1LNH.49.17.B06.1.454.heavy.3.raw
  modified_base (442)..(442): a, c, t, g, unknown or other
  modified_base (468)..(468): a, c, t, g, unknown or other
agtcgagagacacgaccggtgctcgatttagtcgatagtgaaggggctctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcaggactccgtgaggggccgattcaccatcctcagagacagttccgatcgacacagtgtatctgcaaatgaacagcctganacctgaggacacggctctcttttacngtgcgcaggaagcagtg

SEQ ID NO: 528612 - DNA, 522 bp, Homo sapiens
  misc_feature: HEFZJCU01AH4JM.40.38.D05.1.454.heavy.3.raw
tctagcgactcacgaccggtgctcgatttagtatctgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggaccacggaccaaatacttactgtgtagaaggatcgaggaaggtggagcgtggtaggcctcaatac

SEQ ID NO: 528613 - DNA, 548 bp, Homo sapiens
  misc_feature: HEFZJCU01C7YKQ.11.85.H08.1.454.heavy.3.raw
  modified_base (492)..(492): a, c, t, g, unknown or other
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgttgtcagacgatccggcccataacttggctcggcccctgggggcccgggaacccgtcgtcgaccgtctcctcngcctccacccaacgggcccactcggtctttccccctggccaccctcctccaggacg

SEQ ID NO: 528614 - DNA, 570 bp, Homo sapiens
  misc_feature: HEFZJCU01DOQYG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggcctgtctattattgcgcgagagagacacacgaacctactggccaatactagtgggggcttggttcttgggggaccgagggggaccctgggtccattccggtccttcccccaggcccttacccaacccgaaacggggccccagtccgggttcctttccccccgttcgggcccgccccgtc

SEQ ID NO: 528615 - DNA, 510 bp, Homo sapiens; identical to SEQ ID NO: 457760
  misc_feature: HEFZJCU01BFV8L.51.12.B01.1.454.heavy.3.raw

SEQ ID NO: 528616 - DNA, 508 bp, Homo sapiens
  misc_feature: HEFZJCU01A0TUO.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggacagggtcgtcatgaccggggacacgtccatcgccacgacttacatggaactgaccagtctgacatttgacgacacggccgtctattactgtgcgacagaagcggcggacagaggttcgcttactggtcgaggctcc

SEQ ID NO: 528617 - DNA, 518 bp, Homo sapiens
  misc_feature: HEFZJCU01EG9C8.13.76.G10.1.454.heavy.3.raw
  modified_base (406)..(406): a, c, t, g, unknown or other
  modified_base (455)..(455): a, c, t, g, unknown or other
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagacctccgtgaggggccgattcaccatctccagagacaattccaagaanacgctgtttctcaaatgaacagcctgagagccgatgacacggccgtgtnttactgtgcgagagagtggggcccacgaacgttactacgctatggacgtcgtggggccgtaac

SEQ ID NO: 528618 - DNA, 415 bp, Homo sapiens
  misc_feature: HEFZJCU01EPKYR.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagtatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 528619 - DNA, 509 bp, Homo sapiens
  misc_feature: HEFZJCU01D2ZXR.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgttgacgagagtcccacgatccggtagagcctacggctagcggcctttagacttcgtc

SEQ ID NO: 528620 - DNA, 513 bp, Homo sapiens
  misc_feature: HEFZJCU01BMUVV.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttggaggagcctgacatctgacgacacggccgtctattactgtgcgagagtcccacgagtccggtgagccctacgggcaggcggtccctttggacttcgtc

SEQ ID NO: 528621 - DNA, 515 bp, Homo sapiens
  misc_feature: HEFZJCU01B5SHV.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtgggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgcagcctccaccaacgggccca

SEQ ID NO: 528622 - DNA, 530 bp, Homo sapiens
  misc_feature: HEFZJCU01C1PIZ.9.34.D01.1.454.heavy.3.raw
tgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaagggcccatcggtcttccccctggccaccctcctcccaagagc

SEQ ID NO: 528623 - DNA, 532 bp, Homo sapiens
  misc_feature: HEFZJCU01BCP0V.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacggaacgttacgtacgctatggacgtctcgggggccgaagggaccgacc

SEQ ID NO: 528624 - DNA, 506 bp, Homo sapiens
  misc_feature: HEFZJCU01C0QXC.17.10.A10.1.454.heavy.3.raw
cgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgacgagctgacgacacggccgtctattactgtgcgagaatgttttctgtcatcgtactaatttgattaggctctatggactggacttcgtc

SEQ ID NO: 528625 - DNA, 511 bp, Homo sapiens; identical to SEQ ID NO: 490838
  misc_feature: HEFZJCU01D595K.15.67.G01.1.454.heavy.3.raw

SEQ ID NO: 528626 - DNA, 518 bp, Homo sapiens
  misc_feature: HEFZJCU01B359G.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggccaccctcctccaagacgcacctctggggcacagcggccctggcgtgcctggtcaaggactacttcctagagacag

SEQ ID NO: 528627 - DNA, 511 bp, Homo sapiens
  misc_feature: HEFZJCU01EK93Q.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacactcagcgaacacagtcaacatggagttgcggagctgcgatctgacgacgcggccgtatattactgtgcgagagtacgtagcggctcgtctttgactactggggcctgggaactctggtcacgtct

SEQ ID NO: 528628 - DNA, 396 bp, Homo sapiens
  misc_feature: HEFZJCU01BIXJS.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgaggtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 528629 - DNA, 469 bp, Homo sapiens
  misc_feature: HEFZJCU01B2LTH.48.13.B02.1.454.heavy.3.raw
agtatacatacacgaccggtgctcgatttagtctagcgacttccgcgggcacgaccggtgctcgatttagacagtatatatcgcgggcacgaccggtgctcgatttagagtgctacgaagggaaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcgagggctcggttactccgatactgactattggggccagggaaccctggtcaccgtctcctcagcctccaccaagggcccatcggtcttccccctggcgccctgctccaggagcacctccgagagcacagcggccctgggctgccctggtcaaggactacttcctatgtatact

SEQ ID NO: 528630 - DNA, 521 bp, Homo sapiens
  misc_feature: HEFZJCU01D0W8E.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccgagcgggagttccaagtactcctttgacgtctggggccgtac

SEQ ID NO: 528631 - DNA, 498 bp, Homo sapiens
  misc_feature: HEFZJCU01ELNS1.40.81.H04.1.454.heavy.3.raw
  modified_base (484)..(484): a, c, t, g, unknown or other
tctagcgactcacgaccggtgctcgatttagtagtgtagattcgcggggtgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggggtttgagtggatgggggtggatcaaccctaccagaggtggcacaaagtatcgacagaactttcagggcagggtcaccatgacctgggacgcgtccatcagcacagtctacatggatctgagcgggactggacctacgtcgacgactaacgggccatgtattactgtggaagagacgttggnggctacggcggctg

SEQ ID NO: 528632 - DNA, 530 bp, Homo sapiens
  misc_feature: HEFZJCU01EHY9Z.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatggcactgggtccgccaggcttccgggaaagggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactcgtaccacatccctgaaagcgtcaacgtactaactactacggtatggtacc

SEQ ID NO: 528633 - DNA, 528 bp, Homo sapiens; identical to SEQ ID NO: 447390
  misc_feature: HEFZJCU01AVAIX.12.40.D07.1.454.heavy.3.raw

SEQ ID NO: 528634 - DNA, 511 bp, Homo sapiens
  misc_feature: HEFZJCU01EAOKH.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctgggggtccctgagactctcgtgtgcggcctctggattcatctctacaaactattggatgagctgggtccgtcaggctccagggaaggggctggagtgggtggccagcatgaacggagatggagtcaaaagactatgtggactctgtgaagggccgattcaccatctccagagacaacgccaagaactcactgtatctgcaaatgaacagcctaagacccgaggaccaggctgtgtattactgtgcgagagaccggctacgtggggcccgggagcccgtggtcc

SEQ ID NO: 528635 - DNA, 527 bp, Homo sapiens
  misc_feature: HEFZJCU01DRZTB.9.70.G04.1.454.heavy.3.raw
  modified_base (325)..(325): a, c, t, g, unknown or other
  modified_base (349)..(349): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccnccatctacaacccgtccctcaagngtcgagtcagcatgtcagtcgacacgtcccagaaccagttctccctgaccagtgagttatatgaccgccgcagacacggccgtgtattactgtgcgagagaggccgttattttaggaccagctagtttaaaaactccttaacgtacggtctggacgtcgtggggccgaggggaccaac

SEQ ID NO: 528636 - DNA, 527 bp, Homo sapiens
  misc_feature: HEFZJCU01EKOGX.52.67.G01.1.454.heavy.3.raw
cgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattggggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaatgaagacacggactgtatattactgtgcgaggaggggaaagtaggggtaaggtagttttggagttaattatttagttactgggcggttcggacggacgtcgtc

SEQ ID NO: 528637 - DNA, 536 bp, Homo sapiens
  misc_feature: HEFZJCU01BN0HZ.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacgacggccgtgtattactgtgcgagacgacccctccgatagcagtggctggtccactaggtttgactacgtggggccaggggaagccgtttggtccaccggtctccctcacgcctacccg

SEQ ID NO: 528638 - DNA, 518 bp, Homo sapiens
  misc_feature: HEFZJCU01DJ12M.22.28.C06.1.454.heavy.3.raw
acatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtcccagggcagggactggaatggattggatatttccatacgactgcgatgaccaactgcaacccctccctcagggctcgagtcagcctgtcagtagacacgtccaagaaccagacttccctgagactgacctctgtgaccgccgcagacacggccgtgtatttctgtgtcggtacgagtgtccatgacagtcacaaacaactggtctcctgggccagggaaccctggtcaccgtctcctcagcctccaccaagggcccatcggtctcccctggcaccctcctccaagagcacctctggggcacagcc

SEQ ID NO: 528639 - DNA, 552 bp, Homo sapiens
  misc_feature: HEFZJCU01B3URC.49.86.H09.1.454.heavy.3.raw
agtcgagagacacgaccggtgctcgatttagtgctatagacttgggtttgggtatagacttgggtttggggggaagaggaagactgacggtccccccaggagttcaggtgctgggcacggtgggcaacttatgagcccgaaaggacatggccacggggtgggtagggacatagggccagatgccagcctgaggtggagcctcaggtcacaggtgggcacggacactatccacataagcgagggatagacccgagtgtcccccacagcagacctgagagcgctgggcccacagcctcccctcagagccctgctgcctcctccggtcagccctggacatcccaggtttccccaggccctggcggtaggtttagaatgaggtctgtgtcactgtggtattacgatattttgactggtttggatgactcttacttctacttctacgttatggacctctgggccaagggaccacggtcaccgtctcctcagcctccaccaagggccccatcggtcttccccctggcaccctcctccaagagcacctctgggggcacg

SEQ ID NO: 528640 - DNA, 527 bp, Homo sapiens
  misc_feature: HEFZJCU01D0Z41.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggcctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtcgacccctgggggcccacggggaaccctgggtccaccgtctcctcag

SEQ ID NO: 528641 - DNA, 527 bp, Homo sapiens
  misc_feature: HEFZJCU01C7CLK.49.9.A09.1.454.heavy.3.raw
agtcgagagacacgaccggtgctcgatttagcgagacgcgcaggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagtttacagtgaccacgcggactctgtgaagggccgattcaccgtctccagagaaaacgccaagaacatggtgtatctgcaaatgactggcctgagagccgaggacacggcagtttattactgtgcaagaggcttgtggtcgactgtcgacctggactggtacttcgattctggtggggccgtggcctacccg

SEQ ID NO: 528642 - DNA, 500 bp, Homo sapiens
  misc_feature: HEFZJCU01A3YU1.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagttgggctgagctgggttttcctcgttgctcttttaagagatgtccagtgtcagatgcagatggtggagtctggggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtagtatctgcaaatgaccagcctgagagccgaggacgacgggttgtttattactgtgggagaaatcctagtggcta

SEQ ID NO: 528643 - DNA, 495 bp, Homo sapiens
  misc_feature: HEFZJCU01EDMN0.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtccttcccctggcgccctgctccaggagcacctccgagagcacagcggccctcgggcgtgccgtggtcaagg

SEQ ID NO: 528644 - DNA, 512 bp, Homo sapiens
  misc_feature: HEFZJCU01CIJAQ.53.49.E05.1.454.heavy.3.raw
cgcgtatacacacgaccggtgctcgatttagagcgactagcaacacacaaagggggctctgggagaggagcccagcactagaagtcggcggtgtttccattcggtgatcagcactgaacacaggaggactcaccatggagtttgggctgaactgggttttcctcgttgctcttttaagaggtgtccagtgtcaggtacaactggtggagtctgggggaggcgtggtccagcctggaggtccctgagactctcctgtgcagcctctggattccccttccatgtatttgccatgcattgggtccgccaggctccaggcaagggggctggagtgggtggcagttatatcctttgatggaagtaacaaatattatggagagtccatgaagggccgattcaccatctccagagacaattccaagaacatagtgtatctgcaaatgaacggctgagaggtgacgacacggctgtgtattactgtgcgaaagataatcccccgcctagagacttttggt

SEQ ID NO: 528645 - DNA, 528 bp, Homo sapiens
  misc_feature: HEFZJCU01EKYNA.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccgaagggaccgac

SEQ ID NO: 528646 - DNA, 497 bp, Homo sapiens
  misc_feature: HEFZJCU01EV83Y.53.4.A04.1.454.heavy.3.raw
  modified_base (488)..(488): a, c, t, g, unknown or other
cgcgtatacacacgaccggtgctcgatttagagtagtgatcagggggctctgggagacgagcccagcactggaagtcgccggtgtttccattcggtgatcatcactgaacacagaggactcaccatggagtttgggctgagctgggttttcctcgttgctgttttaagaggtgtccagtgtcaggtgcatctggtggagtctgggggaggcgtggtccagcctggggggtccctgagactctcctgtgcagcctctggattcaccttcagtacctatcctattcactgggtccgccaggctccaggcaagggcctggagtgggtggcacttatatcatatgatggaggtgataaatactacgcagactccgtgaagggccgattcgccatctccagagacaattaccaagaacaccctctatctacaaatgaagagactgagactgaggacacggctgtctattactgtgcgagagtcggtctttagngatgcctac

SEQ ID NO: 528647 - DNA, 543 bp, Homo sapiens
  misc_feature: HEFZJCU01EYR70.17.28.C06.1.454.heavy.3.raw
  modified_base (529)..(529): a, c, t, g, unknown or other
cgtagactagcacgaccggtgctcgatttagagctcacgtattgggtttggggctcagagaggaggcttagccctggactccaaggcctttccacttggtgatcagcactgagcacagaggactcaccatggaggttggggctgaactgggttttccttgttgctgttttagaaggtgtccagtgtgaggtccagttggttgaggtccgggggaggcctggtccagccgtggggggtccctgagactctcctgtgcagcctccggacttccccttcagtagttattggatgacttgggtccgccagactccaggggaaggggctggagtgggtggccaacataaagcaagatggaactgccgtagttttacggtggactctgtgaagggtccgtttcaccatctccagagacaacgccaagaattcactgtatctacaactgaacagcctgagagtcgcagacacggccgtgtattactgtgcgagatgtaggaaaagtatggctgtgtttagttggggccaggggacnccctggtccaccgt

SEQ ID NO: 528648 - DNA, 493 bp, Homo sapiens
  misc_feature: HEFZJCU01BXO3V.49.35.D02.1.454.heavy.3.raw
agtcgagagacacgaccggtgctcgatttagcacacgatagttgggtttggggtctgggagacgagcccagcactggaagtcgccggtgtttccattcggtgatcatcactgaacacagaggactcaccatggagtttgggctgagcgtgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgatcttatgccgactccgtgaagggccgattcaccatctccagagacattccaagaacacactatatcttcaaatgaacactctgagacgtgagacacggctggtctattactgtgcgacgtgagtatgtcttta

SEQ ID NO: 528649 - DNA, 516 bp, Homo sapiens
  misc_feature: HEFZJCU01CTSXA.49.12.B01.1.454.heavy.3.raw
agtcgagagacacgaccggtgctcgatttagtagtgtagattccgcgggcacgaccggtgctcgatttagtagtgtagattccgcgggcacgaccggtgctcgatttagtagtgtagatttgggtttgggggagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaaagaatatgctatttctgcaaatgaacag

SEQ ID NO: 528650 - DNA, 496 bp, Homo sapiens
  misc_feature: HEFZJCU01BTS7A.3.48.E04.1.454.heavy.3.raw
  modified_base (401)..(401): a, c, t, g, unknown or other
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagngacaactccaacaacacactggatctaccaaatgaacagcctgagagtcgagggcacggccgtatattactttgcgtcccttgatttactagtgt

SEQ ID NO: 528651 - DNA, 523 bp, Homo sapiens
  misc_feature: HEFZJCU01D45B7.8.34.D01.1.454.heavy.3.raw
ctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagcgggagttccaagtactcctttacg

SEQ ID NO: 528652 - DNA, 521 bp, Homo sapiens
  misc_feature: HEFZJCU01B6NR0.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgacccacgaactcctccataaacacagcctacatggagttgaggagcctgacatctgacgacacggccgtctattactgtgcgagagtcccacgatccggtgagcctacggcagccggtcctttagactttcgtgggggtcccaggggtaccg

SEQ ID NO: 528653 - DNA, 498 bp, Homo sapiens
  misc_feature: HEFZJCU01EM1LG.3.26.C04.1.454.heavy.3.raw
  modified_base (448)..(448): a, c, t, g, unknown or other
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttccccctggccgccctgctccnggagcacctccgagagcacagcggccctgggctgccgtgtcaaggactac

SEQ ID NO: 528654 - DNA, 514 bp, Homo sapiens
  misc_feature: HEFZJCU01CL9MM.49.81.H04.1.454.heavy.3.raw
agtcgagagacacgaccggtgctcgatttagtagtgtagattcgcggggtctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcggaatgatggaagtaagaagtactatgcagactccgtgaagggccgattcaccatctccagagacaattccaagaacacgctatatttgcacatgaaacagcctgagagctgaggacacggctatttattactgtgcgaacttaatcacggaggacgaagggtgacccccgtccact

SEQ ID NO: 528655 - DNA, 531 bp, Homo sapiens
  misc_feature: HEFZJCU01EIQK3.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgagttcaccatctccagagacaattccgggaacacactgtctctgcaaatgaacagcctgagagctgaggacagggctgtttattactgtgtgcgatccgacctcactggtacggggagttacttcctccgcaacggtatggacgtcgtggggccaagggaccacggtcaccgtctccttagcctccaccaaggcccatcggtcttcccctgcaccctcctccagagcacctctc

SEQ ID NO: 528656 - DNA, 521 bp, Homo sapiens
  misc_feature: HEFZJCU01AO12G.49.59.F04.1.454.heavy.3.raw
agtcgagagacacgaccggtgctcgatttagtacacacacttagggattggggcagctacaggtgtccagtccctggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttcccctggcaccctcctccagagcacctctggggcacagcggccctgggctcggcctggtcaa

SEQ ID NO: 528657 - DNA, 543 bp, Homo sapiens
  misc_feature: HEFZJCU01EMRXL.48.81.H04.1.454.heavy.3.raw
agtatacatacacgaccggtgctcgatttagtagtgtagattcgcggggaggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaatggaaacgtggagtactatgcggagtctgtgaagggccggttcaccatctacagagacgaacggcaagaagtcgctgtttctgcaatgaacagcctgacctccgacgacacggctctctatttattgtgtgagagaatccgtgggggacccggccggtcttcggggggccgaggggacacttggttatcgtctcttcg

SEQ ID NO: 528658 - DNA, 484 bp, Homo sapiens
  misc_feature: HEFZJCU01B3K5C.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttggggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctcccgagagcacagcggccctcgggctgcctggtcaaggactacttccagacgtatca

SEQ ID NO: 528659 - DNA, 535 bp, Homo sapiens
  misc_feature: HEFZJCU01C6ZDV.17.34.D01.1.454.heavy.3.raw
  modified_base (457)..(457): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtncgaggagtaattactataacactagctcctttttactaccttccctttgacttctggggtccatggaaccccggtccg

SEQ ID NO: 528660 - DNA, 496 bp, Homo sapiens
  misc_feature: HEFZJCU01C1GUG.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcaggtggatagtcgacaaattactactta

SEQ ID NO: 528661 - DNA, 522 bp, Homo sapiens
  misc_feature: HEFZJCU01EDS8T.9.33.C11.1.454.heavy.3.raw
  modified_base (351)..(351): a, c, t, g, unknown or other
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcacgtgggtccgccaggctccaggcaaggcttggagtggctggcagttgtttcatctgaaggaagtgttcaatactatacagactccgtgaagggccgattcaccatcgtccagagacaattccaagaacacgatgtatctgcaaatcgganagcctaagagttgaggacaggctgtttattactgtacgaaaagaggggggatacgagtggcagctccaagtactacttttgacttctgggggccagggaaccctggtcaccggtctcctcagcctccaccgaaggcccatcggtcttcccctggccgcctgctccaggagc

SEQ ID NO: 528662 - DNA, 513 bp, Homo sapiens
  misc_feature: HEFZJCU01ELC5S.53.49.E05.1.454.heavy.3.raw
cgcgtatacacacgaccggtgctcgatttagagcgactagcaacacacaaagggggctctgggagaggagcccagcactagaagtcggcggtgtttccattcggtgatcagcactgaacacagaggactcaccatggagtttgggctgaactgggttttcctcgttgctcttttaagaggtgtccagtgtcaggtacaactggtggagtctgggggaggcgtggtccagcctgggaggtccctgagactctcctgtgcagcctctggattccccttccatgtatttgccatgcattgggtccgccaggctccaggcaaggggctggagtgggtggcagttatatcctttgatggaagtaacaaatattatggagagtccatgaagggccgattcaccatctccagagacaattccaagaacatagtgtatctgcaaatgaacggcctgagaggtgacacacggctgtgtattactgtgcgaaagataactcccccgcctgagtacttttgggt

SEQ ID NO: 528663 - DNA, 504 bp, Homo sapiens
  misc_feature: HEFZJCU01AQ3FL.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggcctatcctacagtgaccactccacgctggtcgacctcgtgggccac

SEQ ID NO: 528664 - DNA, 536 bp, Homo sapiens
  misc_feature: HEFZJCU01EZ3I9.49.9.A09.1.454.heavy.3.raw
agtcgagagacacgaccggtgctcgatttagcgagacgcgcaggggggagcccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggctagtttattactgtgacaaggaggcttgtggtcgactgtaccgaccgtggactggtacttcgatctggtgggggccgtggcctacccgt

SEQ ID NO: 528665 - DNA, 515 bp, Homo sapiens
  misc_feature: HEFZJCU01A7E0F.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgacgagagtacgtaagcggctcgtcctttgactactggggcctgggaactcgtgtcaccgtct

SEQ ID NO: 528666 - DNA, 489 bp, Homo sapiens
  misc_feature: HEFZJCU01CU71D.49.27.C05.1.454.heavy.3.raw
  modified_base (448)..(448): a, c, t, g, unknown or other
agtcgagagacacgaccggtgctcgatttagacgcgatcgaagggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagntgaagacacggctgtatattactgtgcgtaacttaataccg

SEQ ID NO: 528667 - DNA, 478 bp, Homo sapiens
  misc_feature: HEFZJCU01B9MHA.52.8.A08.1.454.heavy.3.raw
cgcagtacgacacgaccggtgctcgatttagcatactctacaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggcttcaggcaaggggctggagtgggtggcagttatatcatatgatggaagcaagatatactatgtagactccgtgaagggccgattcatcatctccagagtacaactccgagaacacgctgtatctgcaatgaacaggactgagagctgaagacacggctggtatattactgtgcgtaactt

SEQ ID NO: 528668 - DNA, 518 bp, Homo sapiens
  misc_feature: HEFZJCU01AKHWU.17.25.C03.1.454.heavy.3.raw
  modified_base (493)..(493): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccaccgactccggtcgagccgtaacggcgancgggggggcctttcgtacttcgttc

SEQ ID NO: 528669 - DNA, 550 bp, Homo sapiens
  misc_feature: HEFZJCU01BSJWZ.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacaccggccgtgtattactgtgcgagatgtaggaaaaagtagtaggcttgtgttttagttggggaccgaggggaggcccctggtcctacccg

SEQ ID NO: 528670 - DNA, 508 bp, Homo sapiens
  misc_feature: HEFZJCU01EUA7I.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcacgcggccctttgactttcgtc

SEQ ID NO: 528671 - DNA, 485 bp, Homo sapiens
  misc_feature: HEFZJCU01DSBPS.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattggggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggccccgagcgcagtggctttttgatgtcctttgtatatgt

SEQ ID NO: 528672 - DNA, 502 bp, Homo sapiens
  misc_feature: HEFZJCU01BE2QA.49.59.F04.1.454.heavy.3.raw
agtcgagagacacgaccggtgctcgatttagtacacacacttagggattgggggcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatgggggaggatcatccctattgttggtgtgacaaactacgcacagaaagttccaggacagaatcacgataaccgcggacacatccacgagcacctattttcatggaactgagcagcctcagatccgaggacacggccgtttactactgtgcgagcgatcccggattcccgcgtttcgaggatgactacgt

SEQ ID NO: 528673 - DNA, 499 bp, Homo sapiens
  misc_feature: HEFZJCU01CRR1G.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggcgtccagtgtcaggtgcaactggaggagtctggggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactacgggggcgttcg

SEQ ID NO: 528674 - DNA, 497 bp, Homo sapiens
  misc_feature: HEFZJCU01DD3CV.14.85.H08.1.454.heavy.3.raw
cgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaaggggctggagtggattggggaaatcagtcaaagtggaggcaccaagtacaacccgtccctcgagagtcgagtcaccatatcaatagacacgttccagaatcagttctccctgaggctgacttctgtgacagccgcggacacggctgtgtattactgtgcgagatcttcggctggtacgctcttgactacgtggggccaggggaacccttggtcaccgtctccttca

SEQ ID NO: 528675 - DNA, 519 bp, Homo sapiens
  misc_feature: HEFZJCU01EUSDG.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaagggctggaatgggtggcagttatatcatatgatggaagctatcaatattacgcagattctgtgaagggccgactcaccatctccagagacaattccagaaacaaactgtatcttcaataaacagtctgagacttgaggacacggctgtctattactgtgcgagagactacggtgaccttttctggtatttcgatctctgggccgtggcaccctggtcactgtctcctcggcttccaccagggcccatcggtcttcccctggccgccctgctccaggagcgacctcctcggggtacacgacgccggtcccg

SEQ ID NO: 528676 - DNA, 511 bp, Homo sapiens
  misc_feature: HEFZJCU01D765P.49.81.H04.1.454.heavy.3.raw
agtcgagagacacgaccggtgctcgatttagtagtgtagattcgcgggggctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagagtactatgcagactccgtgaagggccgattcaccatctccagagacaattccaagaacacgctatatttgcacatgaacagcctgagagctgaggacacggctattattactgtgcgaacttaatcacggaggacaaggtcgaccccgtcctacg

SEQ ID NO: 528677 - DNA, 504 bp, Homo sapiens
  misc_feature: HEFZJCU01DPEO8.51.83.H06.1.454.heavy.3.raw
  modified_base (476)..(476): a, c, t, g, unknown or other
cgatcgtatacacgaccggtgctcgatttagatcacgtgcgtcgcggggctgggagacgagcccagcactggaagtcgccggtgtttccattcggtgatcatcactgaacacagaggactccaccatggagtttgggctgaggctgggttttcctacgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcacgatctgaggacacggctatctactactgtgtnaaagaattggtttcagtggctactttcg

SEQ ID NO: 528678 - DNA, 510 bp, Homo sapiens
  misc_feature: HEFZJCU01BDMS1.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcaggactccgtgaagggccggttcaccatctccagagacaattccaagaacacactgtatctgacaaatgaacagcctgagagccgacgacacggccatatattactgtgcgaaagcaccggcagttagtcacccatactactttgactacgtgggg

SEQ ID NO: 528679 - DNA, 515 bp, Homo sapiens
  misc_feature: HEFZJCU01DFALY.53.33.C11.1.454.heavy.3.raw
cgcgtatacacacgaccggtgctcgatttagagtgagctcgttgggtttggggggaagaggaagactgacggtcctcccaggagttcaggtgctgggcaccgtgggcatgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctgggccagggaaccctggtcaccgtctcctcagcttccaccaagggcccatcggtccttcccctggcgccctgcctccaggcgctaccg

SEQ ID NO: 528680 - DNA, 495 bp, Homo sapiens
  misc_feature: HEFZJCU01CI9B9.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatagaacagcctgagagctggaggacacggctgtgtattactgtgggagagatggaggtcgatattgta

SEQ ID NO: 528681 - DNA, 538 bp, Homo sapiens
  misc_feature: HEFZJCU01DINP7.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccgagggaaccctggtcaccgtctcctcagcctccaccaagggcccacgtcggtcctttcccctgggccgccctcgcctccaggacgcacctccgacgacg

SEQ ID NO: 528682 - DNA, 503 bp, Homo sapiens
  misc_feature: HEFZJCU01EGQBV.49.80.H03.1.454.heavy.3.raw
  modified_base (471)..(471): a, c, t, g, unknown or other
agtcgagagacacgaccggtgctcgatttagctgtgcgtcgaaggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggcttgatatctgggccaagggacaatggtcgattgtctcttcagcctccaccaaggcccatcggtcttcccctggccaccctcctccaagagcacctctcgggggcacagcggcccncgggctgcctggtcaacggactacttcctctc

SEQ ID NO: 528683 - DNA, 505 bp, Homo sapiens
  misc_feature: HEFZJCU01DE17K.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgtagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgtctatggacgtc

SEQ ID NO: 528684 - DNA, 491 bp, Homo sapiens
  misc_feature: HEFZJCU01DA15W.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaatgaacagcctgagagctgaggacacggctgtgtattactgtgggagagatggaggtcgatattgt

SEQ ID NO: 528685 - DNA, 489 bp, Homo sapiens
  misc_feature: HEFZJCU01BU49L.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggccgccctgctccaggagcacctccgagagcacagcggccctgggctgcctggtcaaggactactcctacgtgagct

SEQ ID NO: 528686 - DNA, 492 bp, Homo sapiens
  misc_feature: HEFZJCU01EI2UD.48.71.G05.1.454.heavy.3.raw
agtatacatacacgaccggtgctcgatttagtgtcgtcgcaagagagaggggggcatcacataacaaccacattcctcctctaaagaagtccctgggagcacagctcttcaccatggactggacctggaggttcctctttgtggtgacagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgttgcgacagatggtcgtggattctcgtctgcttat

SEQ ID NO: 528687 - DNA, 518 bp, Homo sapiens
  misc_feature: HEFZJCU01CXV9D.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgaggcgggagttccgaagtactcctttgacgtctggggcc

SEQ ID NO: 528688 - DNA, 490 bp, Homo sapiens
  misc_feature: HEFZJCU01EKLHD.49.17.B06.1.454.heavy.3.raw
agtcgagagacacgaccggtgctcgatttagtcgatagtgaaggggtctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctgaggacaggctctcttttactgtgcgccaggagcagtggctggcccg

SEQ ID NO: 528689 - DNA, 507 bp, Homo sapiens
  misc_feature: HEFZJCU01BUJAZ.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccggcagactccgtgaggggccgattcaccatctccagagacaattccaagaacacgctgtttcttcaaatgaacagcctgagagccgatgacacggccgtgtattactgtgcgagagatggggcccacgaaccgttactacgctatggacgtc

SEQ ID NO: 528690 - DNA, 526 bp, Homo sapiens
  misc_feature: HEFZJCU01DN2WZ.5.64.F09.1.454.heavy.3.raw
  modified_base (416)..(416): a, c, t, g, unknown or other
atcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctggggcaccttcggcaagtttgccattacttgggtgcgacaggcccctggacaagggcttgagtggatgggagggatcgtccctgtctttggagcagcaaactacgcacatgattttcccagggggtagagtcaacgattacggcggacgaatctacggccacagcctatctggagctnaacaacgtgagacctgaagacacggccgtttactactgcgcgagagatcgccccccgagggccgaagacggatagtggggcaacggcttttggccgttctactactacta

SEQ ID NO: 528691 - DNA, 497 bp, Homo sapiens
  misc_feature: HEFZJCU01DN3L9.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggagggggtggtgatccta

SEQ ID NO: 528692 - DNA, 514 bp, Homo sapiens
  misc_feature: HEFZJCU01DXX71.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcacccatcaccaaggacacctccacaaaccaggtggtccttacaatgaccaatatggaccctgtggacacagccacatattactgttcacgctctatggttcggggagttattagtccctactttgactactggggccaggggaactctggtcaccgtctccgcagcctccaccaaggccc

SEQ ID NO: 528693 - DNA, 490 bp, Homo sapiens
  misc_feature: HEFZJCU01AZL94.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaatgaccagcctgagagccgaggacacgggtgtttattactgtgggagaaagtcctaa

SEQ ID NO: 528694 - DNA, 512 bp, Homo sapiens
  misc_feature: HEFZJCU01A6FZN.48.81.H04.1.454.heavy.3.raw
agtatacatacacgaccggtgctcgatttagtagtgtagattcgcggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatggggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggaggtttatcgactctactactttt

SEQ ID NO: 528695 - DNA, 522 bp, Homo sapiens
  misc_feature: HEFZJCU01CM3ND.52.53.E09.1.454.heavy.3.raw
cgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtggaagggccgattcaccatctccagagacgagtccaggaacagcctgtttcttcaaattggacagtctgagacctgacgacacggctgtctattactgtgcggagacgaacccgaggggggcgggagcacggcccccgtaaattcc

SEQ ID NO: 528696 - DNA, 495 bp, Homo sapiens
  misc_feature: HEFZJCU01DGQZT.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccgaggctccaggcaaggggctagagtgggtggcggtcatatcgtccagtggacatcttcagtattacgcagactccctgacggggccgattcaccatctccagagacaattcccagaacacggtctatctgcacctgaccagtcctgagaactgacgacacgtctctctactactgtgcgagagagttagacgagt

SEQ ID NO: 528697 - DNA, 507 bp, Homo sapiens
  misc_feature: HEFZJCU01D3IS2.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaactcctccataaacacagcctacatggagttgaggagcctgacatctgacgacacggccgtctattactgtgcgagacgtcccacgatccgggtgagcctacggcagcggcctttgacttcgtc

SEQ ID NO: 528698 - DNA, 486 bp, Homo sapiens
  misc_feature: HEFZJCU01D86QZ.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcaggggcagagtctccatgaccagtgacgacgtccgcgagcactgtctatatggagatgaggagcctgagacttgacgacacggccgtatattactgtgcgagaatcgaagaaggtggctac

SEQ ID NO: 528699 - DNA, 504 bp, Homo sapiens
  misc_feature: HEFZJCU01DJGF3.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggcccgtggtattactgtgcgagactggccgcaacagactacggtggcaactcctatgcttttgatatctggggccaagggacaa

SEQ ID NO: 528700 - DNA, 516 bp, Homo sapiens
  misc_feature: HEFZJCU01CT2FK.48.12.B01.1.454.heavy.3.raw
agtatacatacacgaccggtgctcgatttagtagtgtagattccgcggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcggcggggaggtggacggaggctcgggttttcggagttagtacatctacttactttacg

SEQ ID NO: 528701 - DNA, 465 bp, Homo sapiens
  misc_feature: HEFZJCU01BV841.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgatttcgatccctccgcagtcgacactttgattactgggtccggggaaccctggtcgccgtctcctcagccctccaccaagggcccatcggtcttccccctggcaccctcctccaagagcacctctgggggcacagcggccctgggctgcctggtcaaggacacttccagactagtca

SEQ ID NO: 528702 - DNA, 516 bp, Homo sapiens
  misc_feature: HEFZJCU01EY7WH.49.26.C04.1.454.heavy.3.raw
agtcgagagacacgaccggtgctcgatttagtctagcgactttgggtttgggcacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatgggtggtatccacctactatgcagactctgtggaagggtcgattcaccatcctccagagacaacagcagaaactccctgtatctgacaaatgaacagtctcagaggtgagacaccgccttctacta

SEQ ID NO: 528703 - DNA, 392 bp, Homo sapiens
  misc_feature: HEFZJCU01BQ215.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagcccgaagacacggccgtctactactgtgcgaaagaagggcgtgggagttacttatatggtgatatggtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 528704 - DNA, 491 bp, Homo sapiens
  misc_feature: HEFZJCU01DBTYG.10.55.E11.1.454.heavy.3.raw
  modified_base (320)..(320): a, c, t, g, unknown or other
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgcccagaggtttcagggcagagtctccatgaccaggtgacacgtccgcgagcactgtctatatggagatgaggagcctgagacttgacgacacggccgtatattactgtgcggagaatcgaagaggtggctacaatcaac

SEQ ID NO: 528705 - DNA, 502 bp, Homo sapiens
  misc_feature: HEFZJCU01D8DA4.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtaattactgtgcgaaagatttctatagaggtgactaacggggggcgtttcg

SEQ ID NO: 528706 - DNA, 532 bp, Homo sapiens
  misc_feature: HEFZJCU01ESHV2.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctaggtacttttccttcgaaatgaagtgtggttcgattggtgtttgattcgg

SEQ ID NO: 528707 - DNA, 549 bp, Homo sapiens
  misc_feature: HEFZJCU01C6ZPE.17.28.C06.1.454.heavy.3.raw
cgtagactagcacgaccggtgctcgatttagagctcacgtattgggtttggggaggcttagccctggactccaaggcctttccacttggtgatcagcactgagcacagaggactcaccatggagttggggctgaactgggttttccttgttgctgttttagaaggtgtccagtgtgaggtccagttggttgagtccggggggaggcctggtccagcctggggggtccctgagactctcctgtgcagcctccggattccccttcagtagttattggatgacttgggtccgccagactcctagggaaggggctggagtgggtggccaacataaagcaagatggaactgccgagttttacgtggactctgtgaaggccgtttcaccatctccagagacaacgccaagaattcactgtatctacaactgaacagcctgagagtcgcagacacggccgtgtattactgtgcgagatgtggaaaaagtaatggctgtgtttattgggggcctaggggacgcccgtggtccaccggtctccctcaggccttacccg

SEQ ID NO: 528708 - DNA, 517 bp, Homo sapiens
  misc_feature: HEFZJCU01D4W0Q.9.34.D01.1.454.heavy.3.raw
  modified_base (472)..(472): a, c, t, g, unknown or other
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctgggtcgccgtctcctcagcctccaccaagggcccatcgtcttcccctggcgccctgctccaggagcacctccgagagcangccggcccgtgggctgccgtggtcaaggactacttccagacgtat

SEQ ID NO: 528709 - DNA, 509 bp, Homo sapiens
  misc_feature: HEFZJCU01ARUXB.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagcgattccaagacacgttgtatcttcaatgaacagcctgacagtcgacgacacggccatgtatttttgtgtcgagcgacccgggggtctcctcaatggctttcatttacg

SEQ ID NO: 528710 - DNA, 498 bp, Homo sapiens
  misc_feature: HEFZJCU01EG2PH.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgagacacggccatttattactgtgcaaggaacagcataatgactccgtccccggactttacg

SEQ ID NO: 528711 - DNA, 536 bp, Homo sapiens
  misc_feature: HEFZJCU01EHS4D.17.28.C06.1.454.heavy.3.raw
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtataggctgtgtttattggggccaggganccgtggtctaccg

SEQ ID NO: 528712 - DNA, 495 bp, Homo sapiens
  misc_feature: HEFZJCU01EMA40.49.23.C01.1.454.heavy.3.raw
agtcgagagacacgaccggtgctcgatttagtacacgtgattagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacagtctgagacgtgaagacacggctgtctattactgtgcgtactgatatgtctttacg

SEQ ID NO: 528713 - DNA, 506 bp, Homo sapiens
  misc_feature: HEFZJCU01CW789.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagactgaacagcctgggacgccgaggacacggccgtttatcactgtgacgaaagatatttagtaatgatggta

SEQ ID NO: 528714 - DNA, 489 bp, Homo sapiens
  misc_feature: HEFZJCU01CW8O6.51.76.G10.1.454.heavy.3.raw
cgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtggggtggcatttatatcagatgatggcagtaataaagagtatgcagtctccgtgaagggccgattcaccatctccagagacaattcccagaacacactgtatctgcaaatgaacagattgagagctggaggacacgggctggtgtatttctgtgcgaaacgctatgagtgggta

SEQ ID NO: 528715 - DNA, 527 bp, Homo sapiens
  misc_feature: HEFZJCU01CY1S7.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactggggtccgccaggctccaggcaaggggctggaatgggtggcagttatatggtttgatggaactaacaaattctatgcagactccgtgaagggccgattcaccatctccagagacaatttcgagtaacgacattgaatctacagatgaacagtctgagagccgaggacacggctgtctattattgtgcgagagtaagtggtcatggtcctttgaccagtgggccagggaaccctggtcaccgtctcctcagcttccaccaagggcccatccggtcttccccgtggccgcccgtcgctccgacggacgcacctcgtcgggggcacgagccggtccc

SEQ ID NO: 528716 - DNA, 514 bp, Homo sapiens
  misc_feature: HEFZJCU01D6ZBB.3.34.D01.1.454.heavy.3.raw
  modified_base (369)..(369): a, c, t, g, unknown or other
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctaactacgagaacggattgggcncctggggccaagggaccacgggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 528717 - DNA, 523 bp, Homo sapiens
  misc_feature: HEFZJCU01BGSGV.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgacccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgccggacagatgatttttggatgttctgggccaaggtacagcggtcacgtcgcctcagcctccaccagggccatcggtcttccccctcggccacccgtcctccaagacgcacctctgggggtcacgac

SEQ ID NO: 528718 - DNA, 523 bp, Homo sapiens
  misc_feature: HEFZJCU01BSKEI.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctctttttatttatagtagtggtagtacatactccgcagactccgtgaggggccgattcaccatctccagagacaattccaagaacacgactgtttcttcaaatgaacagcctgagagccgatgacacggccgtgtattactgtgcgagagatggggccacgaacgttactacgctatcggacgtctggggcccaagggacccg

SEQ ID NO: 528719 - DNA, 535 bp, Homo sapiens
  misc_feature: HEFZJCU01BRSMU.17.28.C06.1.454.heavy.3.raw
cgtagactagcacgaccggtgctcgatttagagctcacgtattgggtttggggagggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggcgtttcaccatctccagagacaacgccaagaattcactgtatctacactgaacagcctgagagtcgcagacacggccgtgtattactgtgcgagatgtggaaaagtaatggctgtgtttattggggccagggagccctggtctaccg

SEQ ID NO: 528720 - DNA, 538 bp, Homo sapiens
  misc_feature: HEFZJCU01B5GH0.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatatactacaaatggatagcctagaaaatcgaaggatacaggttagtttaattacgttagttccgacgaagggaatggtcggttctcgtcggggtccggaacgggacgt

SEQ ID NO: 528721 - DNA, 503 bp, Homo sapiens
  misc_feature: HEFZJCU01CKSOX.10.53.E09.1.454.heavy.3.raw
catagtagtgcacgaccggtgctcgatttagagagagtgtgttgggtttgggggagacgagcccagcactggaagtcgccggtgtttccattcgttgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaacgacaatttgaagaacgacgcttgtttctgcaaatgaacacgcctgagagctgaggacacggctgtgtattacttgttcgtttggttctgactcggtacgggggaa

SEQ ID NO: 528722 - DNA, 524 bp, Homo sapiens
  misc_feature: HEFZJCU01CMY6S.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcagcagtcgagtcacctttcgcttgacacgtccaacaaccagttttctcttgatcaaaaccccgacgaccgcgccgacagcctcggcccctggggccccagaaaccccg

SEQ ID NO: 528723 - DNA, 507 bp, Homo sapiens
  misc_feature: HEFZJCU01A16B9.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgcctcaacttctggggccagggac

SEQ ID NO: 528724 - DNA, 505 bp, Homo sapiens
  misc_feature: HEFZJCU01ERR7L.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacattcttgtatcttcacatgcacaatctgagagtcgacgacacggccacctattattgtgcgcgacatgactacgctcaatttctggggaccg

SEQ ID NO: 528725 - DNA, 515 bp, Homo sapiens
  misc_feature: HEFZJCU01D0Z6G.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggcctgagcggcctgagacctgaggacgaccggccactttactactgtgcggcgggggagggtgggacggagcttcgggttttcggagttatcatctactactttgt

SEQ ID NO: 528726 - DNA, 515 bp, Homo sapiens
  misc_feature: HEFZJCU01BTC95.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagaccgtctattactgtgttaggtagttttacgtattttggtagtggatatta

SEQ ID NO: 528727 - DNA, 509 bp, Homo sapiens; identical to SEQ ID NO: 491050
  misc_feature: HEFZJCU01BH2QQ.10.88.H11.1.454.heavy.3.raw

SEQ ID NO: 528728 - DNA, 523 bp, Homo sapiens
  misc_feature: HEFZJCU01BUZCH.3.82.H05.1.454.heavy.3.raw
  modified_base (472)..(472): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagnttcgagtggttcggggacctcaccctggttctacttcgatctctgggccgt

SEQ ID NO: 528729 - DNA, 515 bp, Homo sapiens
  misc_feature: HEFZJCU01BMQ44.15.67.G01.1.454.heavy.3.raw
  modified_base (498)..(498): a, c, t, g, unknown or other
  modified_base (506)..(506): a, c, t, g, unknown or other
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctgggagtgggtggccaacataaacaaagacggaagtcaagaaaaactatgtggactctgtgaacggccgattcaccatctccagagacaacgccaagaattcactgtatttgcaaatgaacagcctgagaggcgaggacacggccgtgtattattgtgcgcgagatgatagtagacctntacagtancaggtggta

SEQ ID NO: 528730 - DNA, 512 bp, Homo sapiens
  misc_feature: HEFZJCU01AYMVH.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaactatgtggactctgtgaacggccgattcaccatctccagagacaacgccaagaattcactgtatttgctaaatgaacagcctgagaggcgaggacacggccgtgtattattgtgcgcgagatgatagtagactctacagtagcaggtggta

SEQ ID NO: 528731 - DNA, 522 bp, Homo sapiens
  misc_feature: HEFZJCU01BVAL8.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatagaacagcctgaagaccgaggacacagccgtctattactgttgttagggtagttttacgtagtttttggagtggatatttaa

SEQ ID NO: 528732 - DNA, 507 bp, Homo sapiens
  misc_feature: HEFZJCU01DQ709.4.81.H04.1.454.heavy.3.raw
agcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacacgcaagaactcagtgtttctgcaaatgaacagcctgagagtcgagactcggctgtctactatgtgcgaggaataagggagctaccctacgtatttggactac

SEQ ID NO: 528733 - DNA, 538 bp, Homo sapiens
  misc_feature: HEFZJCU01D3I8L.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagaccccgtgaggggccgattcaccatctccagagacaactctaagaacacgctgtttcttcaatgaacagcctgagagccgatgacacggccgtgtattactgtgcgagagagtggggcccacgaacgttactacgcctatggacgtcgtggggccgaacggggaccaccggtccg

SEQ ID NO: 528734 - DNA, 501 bp, Homo sapiens
  misc_feature: HEFZJCU01A655E.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaaccacggtctatctgcacctgaccagccgtgagaactgtacgacaccgtcttctcttaactctgtgcgagagtagttggacggaagt

SEQ ID NO: 528735 - DNA, 494 bp, Homo sapiens
  misc_feature: HEFZJCU01BQ28L.11.71.G05.1.454.heavy.3.raw
  modified_base (486)..(486): a, c, t, g, unknown or other
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacgacgctgtatctgcaaatgaacagcctgagagctgaggacacggctgtgtattactgtgcgaaagntttctata

SEQ ID NO: 528736 - DNA, 537 bp, Homo sapiens
  misc_feature: HEFZJCU01DE8PV.17.28.C06.1.454.heavy.3.raw
  modified_base (461)..(461): a, c, t, g, unknown or other
  modified_base (483)..(483): a, c, t, g, unknown or other
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagaacncggccgtgtattactgtgcganatgtggaaaaatatggctgtgtttattggggccaggggancccgtggtctaccg

SEQ ID NO: 528737 - DNA, 529 bp, Homo sapiens; identical to SEQ ID NO: 449445
  misc_feature: HEFZJCU01BOJE5.12.40.D07.1.454.heavy.3.raw

SEQ ID NO: 528738 - DNA, 496 bp, Homo sapiens
  misc_feature: HEFZJCU01B38AS.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgacctaagaatggtgccacaaactatgcacagacttttcagggctgggtcaccatgaccagcgacacatctagcaacacagtctacatggagttggaccagccctgaccgacaccggccgtgtatttttgtgtgtagagattttcggactaatccagacgaccccgtgtc

SEQ ID NO: 528739 - DNA, 546 bp, Homo sapiens
  misc_feature: HEFZJCU01BPRSN.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcacgtgggtccgccaagctccaggcaagggattggagtgggtggcagtttgtttcatctgagggcagtgttcaatggtatgcagactccgtgaagggccgattcaccatctccagagacaattccaggaacacaatgtatttggagctgaacagcctaagtcctgacggacacggggcgtatactacgtgtaccggaaaggggacggggggaaccgaacggacggggacgttcccaacgtaaccttccctttcggaccgtccgtc

SEQ ID NO: 528740 - DNA, 498 bp, Homo sapiens
  misc_feature: HEFZJCU01C1TEX.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagccggcctgggctgcctggtcaaggactaccg

SEQ ID NO: 528741 - DNA, 526 bp, Homo sapiens
  misc_feature: HEFZJCU01A7EQI.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttccccgtgcgcctgctccaggagcacctccgacgagacacacggccggcccgt

SEQ ID NO: 528742 - DNA, 505 bp, Homo sapiens
  misc_feature: HEFZJCU01DZBX5.53.54.E10.1.454.heavy.3.raw
cgcgtatacacacgaccggtgctcgatttagatcgtagcagaacacacaaaggggtctgggagaggagcccagcactagaagtcggcggtgtttccattcggtgatcagcactgaacacagaggactcaccatggagtttggggctgagctgggttttcctcgttgctcttttaagaggtgtccagtgtcaggtgcacctggtggagtccgggggaggcgtggtccagcctgggaggtccctgagactctcctgtgtagcctctggattcaccttcagggtctatggcatgaactgggtccgccagactccaggcaaggggctggagtgggtggcatttatatcatttgatggcactaataaatactatgcagactccgtgaggggccgattcaccatctccagagacaattccaagaacatggtgtttctgcaaatgaacagcctgagagttgaagacacggctgtgtattactgtgcgaaacggaatgagtgggaactagggg

SEQ ID NO: 528743 - DNA, 507 bp, Homo sapiens
  misc_feature: HEFZJCU01DYE7N.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccaccttattattgtgcgcgacatgactacgctcaattcgtggggccagggacg

SEQ ID NO: 528744 - DNA, 511 bp, Homo sapiens
  misc_feature: HEFZJCU01BE5RZ.11.57.F02.1.454.heavy.3.raw
  modified_base (487)..(487): a, c, t, g, unknown or other
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcaatacattagcagtagtggtgcgaccatatactacgcagactctgtgaagggccgattcatcatctccagagacaatggcaacaactcactgtatctaggaaatacaanacgcctagagagtcgaggacacgg

SEQ ID NO: 528745 - DNA, 491 bp, Homo sapiens; identical to SEQ ID NO: 446104
  misc_feature: HEFZJCU01EB554.3.34.D01.1.454.heavy.3.raw

SEQ ID NO: 528746 - DNA, 527 bp, Homo sapiens
  misc_feature: HEFZJCU01AY3AG.12.14.B03.1.454.heavy.3.raw
atacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcattttccttttggctattttaaagggtgtccagtgtgaagtgcacttggaacagtcggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaggggctctgttcagggatggggctttgactcctgggccagggaacct

SEQ ID NO: 528747 - DNA, 515 bp, Homo sapiens
  misc_feature: HEFZJCU01B6DHH.48.53.E09.1.454.heavy.3.raw
agtatacatacacgaccggtgctcgatttagagagagtgtgttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtagtctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtgtggcagtggctggtacgtggctctctagtggttcgaccccgttgggggccaggggatacctc

SEQ ID NO: 528748 - DNA, 532 bp, Homo sapiens
  misc_feature: HEFZJCU01CPPAG.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttactacctcccttgacttctggggccatcggaccccggtcaccgtcc

SEQ ID NO: 528749 - DNA, 533 bp, Homo sapiens
  misc_feature: HEFZJCU01BZU3A.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgtcgcgagagagacacacgaacctactggccaatactatgggggcttgttctggggccaggggaccctggtcatcgtctccccagccctccaccaacgggcccatcggtcttccccctcggccgccctcg

SEQ ID NO: 528750 - DNA, 533 bp, Homo sapiens; identical to SEQ ID NO: 446098
  misc_feature: HEFZJCU01ESTE8.7.78.H01.1.454.heavy.3.raw

SEQ ID NO: 528751 - DNA, 515 bp, Homo sapiens
  misc_feature: HEFZJCU01ANNKX.17.25.C03.1.454.heavy.3.raw
  modified_base (419)..(419): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggancctgacatctgacgacgacggccgtcttattactgtgcgagacgtcccaacgactccgggtgacgcctacggcaggcggtacctttgactttcgtc

SEQ ID NO: 528752 - DNA, 536 bp, Homo sapiens
  misc_feature: HEFZJCU01DKE2U.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtcgtcagttattcataccgacggtaccatatatgacgcagactccgtgaagggccgattcaccatctccagagaccattccaagaacaccctatatcttcaatgaacaacctgagagtcgaagacacggccgtagtattactgtgcgagacatgacttcggtcgacccctggggtaccaggggaaccctggtcgacccggtctcccgtcacgtccccg

SEQ ID NO: 528753 - DNA, 544 bp, Homo sapiens
  misc_feature: HEFZJCU01BOMBG.16.87.H10.1.454.heavy.3.raw
tgtactactccacgaccggtgctcgatttagcagtactgcgttgggtttgggggcccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgttgcgaaggctagttcgtggaaacgagttagtgggttggggggtaggtttgggtttttttttcgtttacgtacgggtattc

SEQ ID NO: 528754 - DNA, 506 bp, Homo sapiens
  misc_feature: HEFZJCU01ASQZA.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgaaatgtttctgtcatcgtacaatttgataggctctatggactggacttcgtggggacc

SEQ ID NO: 528755 - DNA, 515 bp, Homo sapiens
  misc_feature: HEFZJCU01DQ888.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccgggtgacgcctacgggcacggccgggtccttttgacctttctc

SEQ ID NO: 528756 - DNA, 520 bp, Homo sapiens
  misc_feature: HEFZJCU01B2Q20.52.78.H01.1.454.heavy.3.raw
cgcagtacgacacgaccggtgctcgatttagtgtgagtagtttgggtttgggaccggtgctcgattcagtgtgaggcgcagctggtggagtctggggggaggcttggtccagcctggggggtccctgacactctcctgtgtagcctctggattcaccttttaacagttattggatgacttgggtccgccaggctccagggaaggggctggagtgggtggccagcgtgaagcatgatggaggtgaggaagactatgcggactctgtgaagggccgattcaccacttccagagacaacatcaaagaactcaatgtatctccaaatgagcagcctgacatccgaggacacggccgtgtattactgtgcgagagttctttgggatgttgtcgttgcaccagctgccctacccggctgctacttcgatctcgtggggccgtggcacccgtggtcactgtcttctcagcctccaccaagggcccagtcggtccttcccctggccaccctcctaccagacgcacctc

SEQ ID NO: 528757 - DNA, 373 bp, Homo sapiens
  misc_feature: HEFZJCU01BUNVM.48.59.F04.1.454.heavy.3.raw
agtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggcggtctattactgtgcgaggcccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactactcctatgtatact

SEQ ID NO: 528758 - DNA, 515 bp, Homo sapiens
  misc_feature: HEFZJCU01DJ66X.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttccttgttgttatttttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaaggtggta

SEQ ID NO: 528759 - DNA, 507 bp, Homo sapiens
  misc_feature: HEFZJCU01DKKOD.3.17.B06.1.454.heavy.3.raw
  modified_base (435)..(435): a, c, t, g, unknown or other
  modified_base (474)..(474): a, c, t, g, unknown or other
agacgcactccacgaccggtgctcgatttagtcgatagtgaagggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttgggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttanctgcaaatgaacagcctgagaaccgacgacacggccgtntattattgtgtcatagacctaggatacaaacgc

SEQ ID NO: 528760 - DNA, 503 bp, Homo sapiens
  misc_feature: HEFZJCU01B9F4Z.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccggaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttcgtc

SEQ ID NO: 528761 - DNA, 523 bp, Homo sapiens
  misc_feature: HEFZJCU01B5HYQ.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaacccacatactactccgaccccggtgaaagggccgattaaccatctccagagacgattccgagaacacggtgtatcttcaaatgaacaactgagagccgacgacacggccgtttattactgtgcgagagattcgagtggttcggggacctcgacccttggtctacttcgatctctc

SEQ ID NO: 528762 - DNA, 506 bp, Homo sapiens
  misc_feature: HEFZJCU01BDDFN.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccagggcccatcggtcttcccctggcaccctcctccaagagcacctcgtgggggcacagcggccctgggctgcctggtcaaggactacttccgagtagtaca

SEQ ID NO: 528763 - DNA, 507 bp, Homo sapiens
  misc_feature: HEFZJCU01C1CUH.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgagggccgctgcatcgtctccagagacaattcgaagaacactctgtacctgcaaatgaacagtctgagagccgaggacacggccgtctacttttgtgcgactagaagtgggagctagtaggggatttgattccg

SEQ ID NO: 528764 - DNA, 523 bp, Homo sapiens
  misc_feature: HEFZJCU01DMYXD.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctcgggtccgccaggctccagggaaggggctggagtgcgtctcttttattatagtagtggtagtacatactccgcagactccgtgagggccgattcaccatctccagagacaattccaagaacacgctgtttcttcaatgaacagcctgagagccgatgacacggccgtgtattactgtgcgagagagtcggggcccacgaacgttactacgctatggtacgtcgtggggccgaacgggaccg

SEQ ID NO: 528765 - DNA, 531 bp, Homo sapiens
  misc_feature: HEFZJCU01DKFU9.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtcttattattgcgcgagagagacacacgaacctactggccaatactatgggggcttgttctggggccaggggaccctggtcatcgtctccccagcctccaccaaggcccatcggtcttccccctggccgtcccgtcg

SEQ ID NO: 528766 - DNA, 531 bp, Homo sapiens
  misc_feature: HEFZJCU01DNA2K.48.34.D01.1.454.heavy.3.raw
agtatacatacacgaccggtgctcgatttagatcgtctgtgttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagtttccctgacgctgacgtctgtgaccgccgcagacacggctgtctatttattgtgcgagactaggcttctgtagtggtggtacttgcaacccgggatactactccaacttcggcttggacatctgggccaagggacctcggtcgtcccg

SEQ ID NO: 528767 - DNA, 385 bp, Homo sapiens
  misc_feature: HEFZJCU01CECLM.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctcttgtgaccgccgcagacacggctgtttattactgtgcgagacgactacctgactccaatccatactttgactattggggccggggagccctggtcaccgtctcctcagcctccaccaaggcccatcggtcttccccctggcgccctgctccaggagcacctccgagagcacagcggccctgggctgcctggtcaaggactacttcccatactcgta

SEQ ID NO: 528768 - DNA, 503 bp, Homo sapiens
  misc_feature: HEFZJCU01EAG6Q.18.50.E06.1.454.heavy.3.raw
  modified_base (476)..(476): a, c, t, g, unknown or other
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggactggagtggctcgcacttatttacagtggcggcactacatactacacagacttcgcgaggggccgattcaccatctccagagacgattccaagaacacgttgtatcttcaaatgaacagacctgacagtcgacgacacggccatgtatttttgtgcgngcgacccggggctcctcaatggctttc

SEQ ID NO: 528769 - DNA, 493 bp, Homo sapiens
  misc_feature: HEFZJCU01DP811.53.30.C08.1.454.heavy.3.raw
cgcgtatacacacgaccggtgctcgatttagtctgacgtcaaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccattattactgtgcaaggaacagcataatgactcgccccggacttt

SEQ ID NO: 528770 - DNA, 514 bp, Homo sapiens
  misc_feature: HEFZJCU01CNMGY.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccatctccagagacaattccaagaacacgctgtttctcaaatgaacagcctgagagccgatgacacggcctggtattactgtgcgagagatggggcccacgaacgttactcgctatggactctggggccaagggacc

SEQ ID NO: 528771 - DNA, 519 bp, Homo sapiens
  misc_feature: HEFZJCU01AFOH8.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtattttagaaggtgtccagtgtgaggtgcagctggtggagtccgggggagctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgagaggccgaggacacggctgtgtattatgtgcgag

SEQ ID NO: 528772 - DNA, 403 bp, Homo sapiens
  misc_feature: HEFZJCU01CYXMO.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggcaccctcctccaagagcacctctgggggcacgagcggccctgggctgcctggtcaaggactacttcccactactatg

SEQ ID NO: 528773 - DNA, 529 bp, Homo sapiens
  misc_feature: HEFZJCU01EGWE3.49.37.D04.1.454.heavy.3.raw
agtcgagagacacgaccggtgctcgatttagtagcatactgttgggtttgggctgagctgggttttccttgttgctattttaaaaggtgtccagtgtgacgtgcaggtggtggagtctggggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttccccctggccgccctgctccacggagcacctccgagagcacagcc

SEQ ID NO: 528774 - DNA, 537 bp, Homo sapiens
  misc_feature: HEFZJCU01BQCEO.52.83.H06.1.454.heavy.3.raw
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctctttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaaccatctccagagacaattccaagaatacgctgtatctgcacatgaacagcctgtagagccgaagacacggggttgttttagttaacttggtacgaacttaaattacggaaggactaaaccggtaacccccggtaccgccgacggcgtaacc

SEQ ID NO: 528775 - DNA, 507 bp, Homo sapiens
  misc_feature: HEFZJCU01A3UJX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctagttactgtgcgagagtcccacgatccggtgacgcctacggcagccggcctttgacttcgtc

SEQ ID NO: 528776 - DNA, 521 bp, Homo sapiens
  misc_feature: HEFZJCU01B0JEM.40.67.G01.1.454.heavy.3.raw
tctagcgactcacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtaggtgggggtacttgcaacccgggatactactccaccttcggctttggactatctggggccggtac

SEQ ID NO: 528777 - DNA, 527 bp, Homo sapiens
  misc_feature: HEFZJCU01CINRI.16.27.C05.1.454.heavy.3.raw
  modified_base (475)..(475): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccgggggagggccgattcaccgtctccagagacaattccaagaacagggtgtttctccaagtgattgatctgagaagtgaggacacggctgtttattactgtgcgnggtggctgaccgctcttgactactgggggccggggagccccggtcatcgtct

SEQ ID NO: 528778 - DNA, 522 bp, Homo sapiens
  misc_feature: HEFZJCU01EPWW6.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggcctctattactgtgcgagagtcccacgactccggtgacgtcccgtaacgggccaaggccggtccttttcggacttttccggtc

SEQ ID NO: 528779 - DNA, 497 bp, Homo sapiens
  misc_feature: HEFZJCU01EKT6X.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggtcgtacctc

SEQ ID NO: 528780 - DNA, 513 bp, Homo sapiens
  misc_feature: HEFZJCU01A672U.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacacctttgattactggggccgggaaccctggtcgccgtctcctcagcctccaccaaggccatcggtcttcccctggcaccctcctccagagcacctctgggggcacagcggccctgggctgcctggtcaaggactacttccagacgtac

SEQ ID NO: 528781 - DNA, 527 bp, Homo sapiens
  misc_feature: HEFZJCU01CATJF.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactaatgggggcttggttctgggggccaggggacctggtcatcgtctccccgagcctccaccaagggcccatccggtcttccccctggccg

SEQ ID NO: 528782 - DNA, 496 bp, Homo sapiens
  misc_feature: HEFZJCU01CGQVU.51.35.D02.1.454.heavy.3.raw
cgatcgtatacacgaccggtgctcgatttagcacacgatagttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttctttttactgtgcgccaggaagcgagtggctgg

SEQ ID NO: 528783 - DNA, 532 bp, Homo sapiens
  misc_feature: HEFZJCU01BU8R5.49.28.C06.1.454.heavy.3.raw
agtcgagagacacgaccggtgctcgatttagagctcacgtattggggtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggagacaacggtaaccccgtccgcacggtacggacgtctggggccaagggaccacggtcaccgtctcctcagcctccaccaacgggcccatcggtcttccccctggccaccctcctccaagagccacctctc

SEQ ID NO: 528784 - DNA, 510 bp, Homo sapiens
  misc_feature: HEFZJCU01EHJL8.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgtcattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggaacactatagtccctggggccagggaaccctcg

SEQ ID NO: 528785 - DNA, 498 bp, Homo sapiens
  misc_feature: HEFZJCU01BMDUL.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggccccctggacaggggtttgagtggatggggtggatcaaccctaccagaggtggcacaaagtatcgacagaactttcagggcaggggtcaccatgacctgggacgcgtccatcagcacagtctacatggatctgagcggactgacctgtcgacgacgaacggccagtgtattactgtggtaagagacgttggtggtctacgcggggctgacac

SEQ ID NO: 528786 - DNA, 531 bp, Homo sapiens
  misc_feature: HEFZJCU01D5RP9.52.87.H10.1.454.heavy.3.raw
cgcagtacgacacgaccggtgctcgatttagcagtactgcgttgggtttggggagctctgagagaggaggccagccctgggattttcaggtgttttcatttggtgatcaggactgaacagagagaactcaccatggagtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtcccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgacgaaagatcgaggtcgcatgactaggtttttggaggtggaccgaaagaacc

SEQ ID NO: 528787 - DNA, 524 bp, Homo sapiens
  misc_feature: HEFZJCU01CFURC.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaactttttacgattatggcatgacctgggtccgccaagctccagggaagggctggagtgggtctctggtctgaattggaatggtgatagtatagattatgcaggctctgtgaggggccgattcaccatctccagagacaacgaccaagaactccctgtttctgcaaatggacaatttgagagaggaagacacggccttattatttctgtgcgagagccctcggcagaagtctggactactactattatggtatggacgtcgtc

SEQ ID NO: 528788 - DNA, 558 bp, Homo sapiens
  misc_feature: HEFZJCU01DKIIM.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggccccaggactggtgaagccttcggggaccctgtccctaaattgcgctgtctctggtgactccatcagcggtagtaaatggtggagttgggtccgccagcccccaggggaaggggctggagtggattgggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggatgtggtttactctggttcaatgagttattatgtcttttggacttagttggggccgagggaaccccgtggtcctaccgtctcctcacgcctccaccgaacgggccc

SEQ ID NO: 528789 - DNA, 530 bp, Homo sapiens
  misc_feature: HEFZJCU01A8N9V.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctgagctgacagcctgtcatctgaggacacgggcttctacttctgtgcgaggagtaattactataacactgctcctttttacacctccttcgaccttctggggccatcggaaccccggtccg

SEQ ID NO: 528790 - DNA, 509 bp, Homo sapiens
  misc_feature: HEFZJCU01CZICG.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaggaggggggagtacagtggcagctccaagtacttac

SEQ ID NO: 528791 - DNA, 529 bp, Homo sapiens
  misc_feature: HEFZJCU01BC2FD.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgaccctgggggccaggggaaccctggtcaccgtctcctcagcctccaccaagggccccatcggtcttccccctggccacctcctccaagagcacctcg

SEQ ID NO: 528792 - DNA, 527 bp, Homo sapiens; identical to SEQ ID NO: 500445
  misc_feature: HEFZJCU01AITW4.7.78.H01.1.454.heavy.3.raw

SEQ ID NO: 528793 - DNA, 507 bp, Homo sapiens
  misc_feature: HEFZJCU01CR4CD.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaagtggtggcacaagactgcacagaagtttcagggcagggtcaccgatgaccagggacaagtccaccaacacagcctacatggaactaaggggactgacatctgacgacacggccatgtattattgtgcgagagaaatgttaggtactgctttgggtcccgtggggcccgggaacccggtcg

SEQ ID NO: 528794 - DNA, 511 bp, Homo sapiens
  misc_feature: HEFZJCU01CQN86.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaacccctccctcaggattccagtcgccatatccctggactcgtccaacaaccagatctccctgacgatgacatctgtgaccgctgcggacacagccgtttattactgtgcgcgatctgggcgactcagtgactatggtatggacgtctggggccgaagggaccacggtcatcgtctcctcagcctccaccaaggccatcggtcttcccctcgca

SEQ ID NO: 528795 - DNA, 541 bp, Homo sapiens
  misc_feature: HEFZJCU01EFUVQ.7.70.G04.1.454.heavy.3.raw
  modified_base (348)..(348): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagngtcgagtaacgatctcagtggacacgtctaacaatcacctctccctgaggctgagctctgtgacagccgcggacacgggcgtttattactgtgcgagagggacggactacggtgactacgtgggggttccgtaccccgtggggacccgaggggaaccctggtaccgaccgtctccgtcacgtcctccgaaccg

SEQ ID NO: 528796 - DNA, 553 bp, Homo sapiens
  misc_feature: HEFZJCU01EY5X2.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcccgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagaacagcctgagacccagacgacacggctgtctattattgcgcgagagaggacacacgaacctactggccaatactatggggcgttgttctgggggtccgacgggggacccgtcggtcatcgtcctccccacgccctcccacccaacgggaccccactcggtccttccccctcgggccgccccgtcg

SEQ ID NO: 528797 - DNA, 511 bp, Homo sapiens
  misc_feature: HEFZJCU01C4OQP.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcactcgtgtcggcccaatttggtttaccggcacacaaaatcaggcaagtcctacgacgtctggtacg

SEQ ID NO: 528798 - DNA, 527 bp, Homo sapiens
  misc_feature: HEFZJCU01BRPHP.9.78.H01.1.454.heavy.3.raw
  modified_base (470)..(470): a, c, t, g, unknown or other
  modified_base (482)..(482): a, c, t, g, unknown or other
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctcaccaaggcccatcggtcttcccctgcgccctgctccaggngcacctccgagngcacagcggcccgtcgggctcgcctggtcaaggactacttccacg

SEQ ID NO: 528799 - DNA, 512 bp, Homo sapiens
  misc_feature: HEFZJCU01BCHWK.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgttcatctgagggcagtgttcaatggtatgcagactccgtgaagggccgattcaccatctccagagacatccaggaacacaatgtattggagctagaacagcctaagtcctgacggacgacgggcgtatactacgtgtaacgaaggggaggggggaaccaggcgggtagtccaacgtactcc

SEQ ID NO: 528800 - DNA, 391 bp, Homo sapiens
  misc_feature: HEFZJCU01COGV4.12.24.C02.1.454.heavy.3.raw
atacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaaggggacaatggtcatcgtctcttcagcctccaccaagggcccatcggtcttccccctggcgccctgctccaggagcacctcccgagagcacagcggccctgggctgcctggtcaaggactactctacgtcgtat

SEQ ID NO: 528801 - DNA, 520 bp, Homo sapiens
  misc_feature: HEFZJCU01AXG3A.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaaacacaatgtatttggagttgaacagcctaagtcctgaggacacgggcgtatactactgtacgaaggaggggggaaccgaggcgggagttccaagtactcctttgacgttc

SEQ ID NO: 528802 - DNA, 378 bp, Homo sapiens; identical to SEQ ID NO: 444463
  misc_feature: HEFZJCU01BHTIX.47.77.G11.1.454.heavy.3.raw

SEQ ID NO: 528803 - DNA, 500 bp, Homo sapiens
  misc_feature: HEFZJCU01EKOP6.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcgtggtttccgtcgttaggctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccggaggacgacggggtcgtttattactgtgggagaaatcctagtgg

SEQ ID NO: 528804 - DNA, 502 bp, Homo sapiens
  misc_feature: HEFZJCU01EA1KH.48.34.D01.1.454.heavy.3.raw
agtatacatacacgaccggtgctcgatttagatcgtctgtgttgggtggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccccgtgcgccctgctccaggagcacctccgagagcacagcggccctgggctgcctggtcaaggactacttcctatgtatact

SEQ ID NO: 528805 - DNA, 501 bp, Homo sapiens
  misc_feature: HEFZJCU01CZ7CQ.40.81.H04.1.454.heavy.3.raw
  modified_base (491)..(491): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccncgtggggccg

SEQ ID NO: 528806 - DNA, 511 bp, Homo sapiens
  misc_feature: HEFZJCU01D5H5T.51.36.D03.1.454.heavy.3.raw
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccggggaaggggcgtggattggattggcagtatcagttataactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggttgacagtggtgcctacgtacggagctttttgattagtttggggaccaaggcaacgaaggtcaccgtctc

SEQ ID NO: 528807 - DNA, 496 bp, Homo sapiens
  misc_feature: HEFZJCU01BOWI1.51.64.F09.1.454.heavy.3.raw
  modified_base (431)..(431): a, c, t, g, unknown or other
cgatcgtatacacgaccggtgctcgatttagcgcgtatacaaggggctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctggggaggtccttgagactctcctgtgcagcctctggattcaccttcagagtctatggcatgaactgggtccgccaggctccaggcaaggggctggagtgggtggcattcatttcagaggatggaatttaagagatactatacagactccgtgaagggccgattcaccatctccagagacaattccaagaactcgctctatctgcaaatgancagcctgagactgaggacacggctgtctattactgtgcgaaacggaatgagtggactagggttta

SEQ ID NO: 528808 - DNA, 538 bp, Homo sapiens
  misc_feature: HEFZJCU01CNDUC.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtcggggcccaacgaacgttactacgctatggaccgtcgtcgggggaccaacggggtaccgac

SEQ ID NO: 528809 - DNA, 539 bp, Homo sapiens
  misc_feature: HEFZJCU01EJRP2.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgcttcctttttacaccttcccttcgtacttcgtggggccacgtcggaaccccggtaccg

SEQ ID NO: 528810 - DNA, 510 bp, Homo sapiens
  misc_feature: HEFZJCU01ESTNA.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtggggcaccagctacaacccctcctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaacgggcccagttcc

SEQ ID NO: 528811 - DNA, 514 bp, Homo sapiens
  misc_feature: HEFZJCU01CVDR3.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgacaaatgaaacagcctgagaggcgaggacacggccgtgtattattgtgcgcgagatgatagtagactctacagtagcaggtggta

SEQ ID NO: 528812 - DNA, 540 bp, Homo sapiens
  misc_feature: HEFZJCU01CCSQN.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcacctttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgtcgaggagtaattactataacactcgtctcctttttacaccttcccttcgtacttcgtggggccagtcggaaccccggtccg

SEQ ID NO: 528813 - DNA, 499 bp, Homo sapiens; identical to SEQ ID NO: 452982
  misc_feature: HEFZJCU01ADQQG.11.71.G05.1.454.heavy.3.raw

SEQ ID NO: 528814 - DNA, 505 bp, Homo sapiens
  misc_feature: HEFZJCU01BQMYJ.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgtcgacagaagcggcggacagaggttcgcttactggttcgagg

SEQ ID NO: 528815 - DNA, 487 bp, Homo sapiens
  misc_feature: HEFZJCU01A3BG2.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatagcaccatctgttgagagtcgactgacaatcaacgtagacacatcgaagaaccagttctccctgcagctgacctctgtgactcccgaggacacgggtgtatattactgttggaagaggcccccataacg

SEQ ID NO: 528816 - DNA, 519 bp, Homo sapiens
  misc_feature: HEFZJCU01C98FN.13.76.G10.1.454.heavy.3.raw
tcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacggaacttactacgctatggacgtctggggccaacgggaccg

SEQ ID NO: 528817 - DNA, 518 bp, Homo sapiens
  misc_feature: HEFZJCU01E0S9V.19.67.G01.1.454.heavy.3.raw
  modified_base (482)..(482): a, c, t, g, unknown or other
tactctcgtgcacgaccggtgctcgatttagagtatacatattgggtttgggggggagaggagcccagcactgggattccgaggtgtttccattcggtgctcagcactgaacacagaggactcaccatggagtttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcgaggtatttttataggtgggacgacattctacggagactccatggagggccgattcaccatctccagagacttttctcagaacacactgtctcttcaaatgaacagcctgagggccgaggacacggccgtctattattgtgtgagagtttanggcgatgggctgggtggacagatcactgggggccac

SEQ ID NO: 528818 - DNA, 528 bp, Homo sapiens
  misc_feature: HEFZJCU01D0HEC.12.58.F03.1.454.heavy.3.raw
  modified_base (514)..(514): a, c, t, g, unknown or other
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttggctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggattttccttacgaatgaagtgtgggtttnatgtgtttgatttc

SEQ ID NO: 528819 - DNA, 503 bp, Homo sapiens
  misc_feature: HEFZJCU01ECD60.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccaggccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgtcgagcgacccggggctcctcaatggctttc

SEQ ID NO: 528820 - DNA, 505 bp, Homo sapiens
  misc_feature: HEFZJCU01BSNRX.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtatttattgtacagttaggacaatatacgg

SEQ ID NO: 528821 - DNA, 504 bp, Homo sapiens
  misc_feature: HEFZJCU01ARTAH.17.25.C03.1.454.heavy.3.raw
  modified_base (420)..(420): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggancctgacatctgacgacacggccgtctattactgtgcgagagtcccacgatccggtgagcctacggcagcggcctttgacttctc

SEQ ID NO: 528822 - DNA, 522 bp, Homo sapiens
  misc_feature: HEFZJCU01D7LQ7.52.52.E08.1.454.heavy.3.raw
cgcagtacgacacgaccggtgctcgatttagtcgagctctcagagagaaaggggatactttctgagactcatggacctcctgcacaagaacatgagacacctgtggttcttcctcctcctggtggcagctcccagatgggtcctgtctcaggtgcagctgcaggagtcgggcccaggactggtgaagccttcggggaccctgtctctcacctgcgctgtctctggtgggtccatcagaagtagtaactggtggagttgggtccgccagcccccagggaagggtctggagtggattggggaaatctatcatactgggaacaccaactacagcccgtccctcaagagtcgagtcgccatatcactagaccaggcgaacaacgagttctcctgaaactgagctctgtgaccgccgcagacacggccgtgtattattgtgggagagatcggagagatagtagtggtttttacgtacggtgactacgacggtatcgggtacgtcgtggggccaaggggaccacggtc

SEQ ID NO: 528823 - DNA, 519 bp, Homo sapiens
  misc_feature: HEFZJCU01DNZKS.51.33.C11.1.454.heavy.3.raw
cgatcgtatacacgaccggtgctcgatttagagtgagctcgttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggccagagtcaccatggaccacagacacgtccacgagcacagcctacatggaactgagggagcctgggatctgacgacacggccgtggttattactgttgcgagagataggccccgagggggagaaggtaggttggtttttccgaccgtctggtcgatta

SEQ ID NO: 528824 - DNA, 509 bp, Homo sapiens
  misc_feature: HEFZJCU01EC1QG.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtcctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagccggccctgggctgctggtcaaggactactcctacgtcgtat

SEQ ID NO: 528825 - DNA, 513 bp, Homo sapiens
  misc_feature: HEFZJCU01EAOWP.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacccctaacactggtggtcacagtgtcttcacccatcctccgggacagacctaccatgaccacgaactcctccataaacacagcctacatggagttgaggagcctgacatctgacgacacggccgtctattactgtgcgagagtcccacgactccggtgagtcctacggccaggcggtccttttgaacttttcg

SEQ ID NO: 528826 - DNA, 536 bp, Homo sapiens
  misc_feature: HEFZJCU01DUCOJ.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtggggtggcagttgtttcatctgagggcagtgttcaatgtatgcagactccgtgaagggccgattcaccatctccagagacaattccaggaaccacaatagtattttggaaaatgaaacaggcctaacgtcctcgaaggacaacggggtgtatactactgtacggaaagggaggggggaaccaggcggggagttccgaagtaactcctttgacgtctggggcctac

SEQ ID NO: 528827 - DNA, 522 bp, Homo sapiens
  misc_feature: HEFZJCU01AFAQ3.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcgtggggccaggggaccctggtcatcgtctccccagcctccaccaagggcccatcggtcttcccctggcg

SEQ ID NO: 528828 - DNA, 503 bp, Homo sapiens
  misc_feature: HEFZJCU01BC94H.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagacgcacagcggcccgtgggctgcctaggtcaaggactacttcctacgtcgtat

SEQ ID NO: 528829 - DNA, 504 bp, Homo sapiens
  misc_feature: HEFZJCU01C5QVV.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaaggtagcagcttccactggggctggatccgccagcccccaggaaaggggctccaatgcgttggacatgtcaattcttatggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaacccgggatactactccaccttcgcttggacatc

SEQ ID NO: 528830 - DNA, 522 bp, Homo sapiens
  misc_feature: HEFZJCU01EI0FU.2.85.H08.1.454.heavy.3.raw
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctgggaggcaccttcaggacctatattatgacctgggtgcgacaggcccctggacaagggcttgagtggctgggggggatcatccctatgtttggtgaagcaaattacgcacagaagttcccggggaagaggtctcgattaccgcggacgaatccacgaacacagcctacatggaagtgaccagcctgagatctgaagacacggccgtgtattactgtgcgaagtcgtattactatgatactggtgattatttgaatttcgactcctaccactacggtatggacgtctggggccgaggggaccacggtcaccgtctcttc

SEQ ID NO: 528831 - DNA, 493 bp, Homo sapiens
  misc_feature: HEFZJCU01BC920.51.6.A06.1.454.heavy.3.raw
cgatcgtatacacgaccggtgctcgatttagatctactgacaggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaacaccctagacgacttaggaggacacgggctaggtcttatttattgtagtcgaggagggag

SEQ ID NO: 528832 - DNA, 522 bp, Homo sapiens
  misc_feature: HEFZJCU01D7UIQ.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagcacaactaacagtgacaccgcacaatacgccgcgtctgtgaaaggcagattcaccatctcaagagatgattcagagaaactcaacttttatctgcaaaatgaacagcctgagaaccgacgacacggccgtctattattgtgtcaatagacctaggatacaacgacggtggtacctggtattc

SEQ ID NO: 528833 - DNA, 554 bp, Homo sapiens
  misc_feature: HEFZJCU01DCDWO.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggggtccctgagactctcctgtgcagcctccggattccccttcagtagttattgggatgacttgggtcccgccagactccagggaaggggctggagtgggtggccaacataaagcaagatggaactgccgagtttacgtggactctgtgaaggggccgtttcaccatctccagagacaacgccaagaattcactgtatctacaactgaacagcctgagagtcgcagacacggccgtgttattactgtggtcgagactgtaggaaaaagtaaataggccgtgtgttttattggggtccaggggagccctgggttcctacccg

SEQ ID NO: 528834 - DNA, 526 bp, Homo sapiens
  misc_feature: HEFZJCU01BIZNU.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcggggcccacgaacgttacacgtctatgggacgtcgtggggccgaagggtacccg

SEQ ID NO: 528835 - DNA, 542 bp, Homo sapiens
  misc_feature: HEFZJCU01A41AP.52.12.B01.1.454.heavy.3.raw
cgcagtacgacacgaccggtgctcgatttagtagtgtagattccgcgggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaaagcgtcgtctacttgcaaatgaacagcctgaaatccgaggacacagccgtgtattactgtactagagagtattggatacgggggaaaattactactccggtatggacgtcgtggggccgaagggaccacggtcaccgtcctcctcacgcctccaccaacc

SEQ ID NO: 528836 - DNA, 490 bp, Homo sapiens; identical to SEQ ID NO: 444500
  misc_feature: HEFZJCU01BI6Y0.19.53.E09.1.454.heavy.3.raw

SEQ ID NO: 528837 - DNA, 514 bp, Homo sapiens
  misc_feature: HEFZJCU01CYH1Y.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccacgactccggtgagcctacggcaggcggcctttgactttcgtcggggccagggacg

SEQ ID NO: 528838 - DNA, 515 bp, Homo sapiens
  misc_feature: HEFZJCU01A57GN.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaagaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaaataaatatgtacatatctacaaatggatagcctagaaatcgaggatacaggtgtttattctgttccacagggaatgacggttctcgtggggccgg

SEQ ID NO: 528839 - DNA, 523 bp, Homo sapiens
  misc_feature: HEFZJCU01BT9TD.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgccagacacggctgtgtattactgtgcgagggggccgggatattgttatagaacccacctgcttatctgagcttggttcgactgcgtcgggggccaggggaacccctgggtctacccg

SEQ ID NO: 528840 - DNA, 532 bp, Homo sapiens
  misc_feature: HEFZJCU01DGAG9.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagtttttggctgagctgggttttccttgttgctatttcaaaaggtgtccagtgtgaggtgcaggttggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgaagaacacggtgtatcttcaaatgaacaacctgagagccgacgacacggccgtttattactgtgcgagagagttcgagtggttcgggggtacctccgaccctggttctactttcgatctctggggccgt

SEQ ID NO: 528841 - DNA, 519 bp, Homo sapiens; identical to SEQ ID NO: 445330
  misc_feature: HEFZJCU01A3F39.7.78.H01.1.454.heavy.3.raw

SEQ ID NO: 528842 - DNA, 499 bp, Homo sapiens
  misc_feature: HEFZJCU01EH3VG.53.26.C04.1.454.heavy.3.raw
cgcgtatacacacgaccggtgctcgatttagtctagcgactttgggtttgggggcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcgagggcaggggtctccatgaccaggggacaggggccaatcagaacagcctacatggagctgaacagactgacatctgacgacacggccgtttattattgtgtgagaggaggacccgatgacctcggc

SEQ ID NO: 528843 - DNA, 534 bp, Homo sapiens
  misc_feature: HEFZJCU01D8QR7.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggtacgggttttggggcggcggactccctcttcgagactcgtcggggccgaggggaccgaagtggtccgaccgtcctccttc

SEQ ID NO: 528844 - DNA, 537 bp, Homo sapiens
  misc_feature: HEFZJCU01C56UQ.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagctaagtcctgaggacacgggcgtagtactactgtacggaaagggaggggggaaccgaggacggggagttccgtaaagtacgtaccttttcggtacgttccgtc

SEQ ID NO: 528845 - DNA, 497 bp, Homo sapiens
  misc_feature: HEFZJCU01D0BR9.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtccttccccctggccgccctgctccagacgcacctccgagagcacagccggcccgtgggcctcggcctggtcaa

SEQ ID NO: 528846 - DNA, 506 bp, Homo sapiens
  misc_feature: HEFZJCU01CTARY.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcgggggggaggcttggtacagcctggggggtccctgagactctcctgtgtagcgtctggattcacattcagtagttatagcatgaactgggtccgccaggctccagggaagggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagacgaccccgaaataggtacgtacg

SEQ ID NO: 528847 - DNA, 491 bp, Homo sapiens; identical to SEQ ID NO: 446104
  misc_feature: HEFZJCU01BDCY6.3.34.D01.1.454.heavy.3.raw

SEQ ID NO: 528848 - DNA, 531 bp, Homo sapiens
  misc_feature: HEFZJCU01DCBM6.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactggggtccgccaggctccagggaaggggctggagtgggtctcagttatttacaattctggtaccacatactactccgaccccgtggaagggccgattaaccatctccagagacgattccgagaacacggtgtatcttcaaatgaacaacctgagagccgacgacacggccgtttattactgtgcgagagattcgagtgggttcggggacctccacccgtggtttctacttcgatctctggggccgtc

SEQ ID NO: 528849 - DNA, 505 bp, Homo sapiens
  misc_feature: HEFZJCU01EXRN5.48.73.G07.1.454.heavy.3.raw
  modified_base (460)..(460): a, c, t, g, unknown or other
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaagtcgaggcaccatatccgtagacacgtccaacgaaccaattctccctgaagctgagctctgtgaccgccgccagacacggctgtctattactgtgcgaggccccgagcgcagtggctttttgtntgctttcgtatatgtggggcgaagggacaagtaggtcacgtcttc

SEQ ID NO: 528850 - DNA, 519 bp, Homo sapiens
  misc_feature: HEFZJCU01C5ODK.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcacatctccagagacaattccaggaacacaatgtatttggaatgaacagcctaagtcctgaggacacgggtgtatactatgtacgaagggaggggggaaccaggcgggagttaccgaagtacttcc

SEQ ID NO: 528851 - DNA, 379 bp, Homo sapiens; identical to SEQ ID NO: 444450
  misc_feature: HEFZJCU01ALE15.47.77.G11.1.454.heavy.3.raw

SEQ ID NO: 528852 - DNA, 509 bp, Homo sapiens
  misc_feature: HEFZJCU01DVL61.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaaatgacgatgcaaaaggagacctactatttggactctgtgaggggccattcatcatctccagagacaacgccgacaactcactgtctctgctgatgagcagcctgagagccgacgacacggctatctattactgtgcgaaactctcattccgttcatctgaatctgggccagggaacctggtcgtccg

SEQ ID NO: 528853 - DNA, 494 bp, Homo sapiens
  misc_feature: HEFZJCU01BRDQF.51.83.H06.1.454.heavy.3.raw
cgatcgtatacacgaccggtgctcgatttagatcacgtgcgtcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggagcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggtcgattcaccgtctccagagacaactccaaaacacgctgtatctccaatgaacagcctcagatctgaggacacggctatctactactgtgtgaaagattagggtttcagtggt

SEQ ID NO: 528854 - DNA, 538 bp, Homo sapiens
  misc_feature: HEFZJCU01A0WY8.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggaggccgattcaccgtctccagagacaattccaagaacagggtgtttctccaagtgattgatctgagaagtgaggacacggctggtttattactgtgcgcggtggctggacccgctcttgacctacgtcgggggccgggggacgccccggtcactcggtcctcc

SEQ ID NO: 528855 - DNA, 481 bp, Homo sapiens
  misc_feature: HEFZJCU01BDE9I.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcactctcctccaagagcacctctgggggcacagcggccctggctgcctggtcaaggactacttcctagagacacg

SEQ ID NO: 528856 - DNA, 532 bp, Homo sapiens
  misc_feature: HEFZJCU01CSM1O.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatccgtctccccacgccctccaccaacgggcccactccggttccttcccccgtggccg

SEQ ID NO: 528857 - DNA, 504 bp, Homo sapiens
  misc_feature: HEFZJCU01EXGMP.17.25.C03.1.454.heavy.3.raw
  modified_base (398)..(398): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacanagcctacatggagttgaggagcctgacatctgacgacacggccgtctattactgtgcgagagtcccacgatccggtgagcctacggcagcggcctttgacttcgtc

SEQ ID NO: 528858 - DNA, 493 bp, Homo sapiens; identical to SEQ ID NO: 453100
  misc_feature: HEFZJCU01CVBWM.14.25.C03.1.454.heavy.3.raw

SEQ ID NO: 528859 - DNA, 525 bp, Homo sapiens
  misc_feature: HEFZJCU01DNHP1.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtccttccccctggccgccctcgctccaggagcacctccgacgacgcacagccggcccgtgggcgtcg

SEQ ID NO: 528860 - DNA, 543 bp, Homo sapiens
  misc_feature: HEFZJCU01BX98R.7.78.H01.1.454.heavy.3.raw
  modified_base (435)..(435): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgcccaggccttcacagggcggtttgtcttctccatggatacctctgtcgggacggcttatctgcagataaccaaccttcaaccggggtnacgacactcgtccgtttatttttgtacgagagcgtcgtctgtcagtggaattgactacgtggggccagggaaccctggtcaccgtctcctcacgcctccaccaacggg

SEQ ID NO: 528861 - DNA, 400 bp, Homo sapiens; identical to SEQ ID NO: 444452
  misc_feature: HEFZJCU01DOD1Q.47.24.C02.1.454.heavy.3.raw

SEQ ID NO: 528862 - DNA, 518 bp, Homo sapiens
  misc_feature: HEFZJCU01ES7JB.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccggggaaccctggtcgccgtctcctcagcctccaccaagggcccatcggtcttccccctggcaccctcctccaacgagcacctctggggcacagcgcctgggctgcctggtcaaggactacttccagacgtatca

SEQ ID NO: 528863 - DNA, 537 bp, Homo sapiens
  misc_feature: HEFZJCU01BT8EJ.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaaccagcctgagcgccgaggacacggccatgtaagttactgtactaaatacgcgggtggccggcggccggtacctccggtatcggtttgtatttcgtggggtccaagggacg

SEQ ID NO: 528864 - DNA, 492 bp, Homo sapiens
  misc_feature: HEFZJCU01CXKHL.52.20.B09.1.454.heavy.3.raw
cgcagtacgacacgaccggtgctcgatttagtgtagtgtgaaggggctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggctctttttactgtgcgccaggaagcaggtggctggccaca

SEQ ID NO: 528865 - DNA, 541 bp, Homo sapiens
  misc_feature: HEFZJCU01CDWDI.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaagtggctgtgtttagttggggccgtagggcgccgtggtcctaccg

SEQ ID NO: 528866 - DNA, 511 bp, Homo sapiens
  misc_feature: HEFZJCU01B4YJP.12.78.H01.1.454.heavy.3.raw
  modified_base (352)..(352): a, c, t, g, unknown or other
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggggancgactggttcgacccctgggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 528867 - DNA, 503 bp, Homo sapiens
  misc_feature: HEFZJCU01B4V18.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtagactgctggtgagacaacagactacgctgctgccttcagaggcagattcaccatcttcagagactgaatcacagagcactctgtttctgcaaatgaactagcctggaagacgcggacacagccatgtatttatgtacattaggacactatacg

SEQ ID NO: 528868 - DNA, 525 bp, Homo sapiens
  misc_feature: HEFZJCU01ANEDK.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgaccctggggccagggaaccctggtcaccgtctcctcagcctccaccaagggcccatcggtcttcccctcggcgccctgctccaggagcacctccgacgacgcacagccggcccctcggg

SEQ ID NO: 528869 - DNA, 522 bp, Homo sapiens
  misc_feature: HEFZJCU01BXYF3.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagtttgtttcatctgagggcagtgttcaatggtatgcagactccgtgaagggccattcaccatctcagagacaattccaggaacacaatgtatttggaaatgaacagcctaagtcctgaggacacgggtgtatactactgtacgaagggaggggggaaccgagacgggagttccaagtactcctttgacgtcgtggggccgtac

SEQ ID NO: 528870 - DNA, 527 bp, Homo sapiens
  misc_feature: HEFZJCU01B5UPL.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagacgtccggggagggccgattcaccgtctccagagacaattccaagaacagggtgtttctcaagtgattgatctgagaagtgaggacacggctgtttattactgtgcgcggtgctgaccgtctctgactacgtggggccgggaggccccggtcatcgtctcc

SEQ ID NO: 528871 - DNA, 511 bp, Homo sapiens
  misc_feature: HEFZJCU01B3NN3.13.33.C11.1.454.heavy.3.raw
  modified_base (436)..(436): a, c, t, g, unknown or other
  modified_base (460)..(460): a, c, t, g, unknown or other
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaaactttcaggacagggtcaccatgaccacggacacgtccatcaacacagcctacatggaactgaggagcctaagatctgacganaccggccgtttattattgtgcaanaagaattgctaaacgatgcttttgattagtgtggggtccaaggggactacg

SEQ ID NO: 528872 - DNA, 505 bp, Homo sapiens
  misc_feature: HEFZJCU01DZVL9.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatgggatgaacgttgacaatgggaatacgagatattcacagaaattccagggcagagtcaccattaccagggacacatccgcgaacacagcctacatggagctgacgggcctgacatctgaagacacggctttatattactgtgcgcgagatggctggcagagagggcacaactggctcgtacccc

SEQ ID NO: 528873 - DNA, 494 bp, Homo sapiens
  misc_feature: HEFZJCU01D1PZI.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgacgagcacagcggccctgggctgcctggtcgaaggactacttccgtatctctccg

SEQ ID NO: 528874 - DNA, 483 bp, Homo sapiens
  misc_feature: HEFZJCU01DQ70R.11.25.C03.1.454.heavy.3.raw
  modified_base (446)..(446): a, c, t, g, unknown or other
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatagagttgggtccgccaggctccagggaagggctggagtgggtctcgtttatttacagtcagtggtagtacatattccgcagactccgtgaaggggtccgagttaccacctatcttcccagtacgaactaactactaagaacacgctgtttcttcaaatgaanagcctagaggagccgatgaactaccggtccgtaggta

SEQ ID NO: 528875 - DNA, 518 bp, Homo sapiens; identical to SEQ ID NO: 449255
  misc_feature: HEFZJCU01AJ9FB.3.17.B06.1.454.heavy.3.raw

SEQ ID NO: 528876 - DNA, 489 bp, Homo sapiens
  misc_feature: HEFZJCU01B3EH0.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctccaaatgaacagcctgagaggcgaggacacggcagtgtattactagtgcgagagatcgacatgtaacg

SEQ ID NO: 528877 - DNA, 534 bp, Homo sapiens
  misc_feature: HEFZJCU01CHQO9.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttaacttgacccctgggggcccggggaacccgtggtcaccgtctccccaccctccaccg

SEQ ID NO: 528878 - DNA, 519 bp, Homo sapiens
  misc_feature: HEFZJCU01BDDBM.49.34.D01.1.454.heavy.3.raw
agtcgagagacacgaccggtgctcgatttagatcgtctgtgttgggtttgggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcgggggatctgtggtccggcctgggaagtccctgagactctcctgtactgcctccggattcaagttcgaaaattatggcttacactgggtccgccaggctccaggcaaggggctggagtgggtgcagtaatttcatatgattcaagtattggatattacgcagagtccgtaaagggccgattcaccatctccagagacaattcgaagaacaccatgtatctggaactgagcagagtcacatctgaggacacgggctatgtattactgtgtagaaagtacttttatgacagtagtggttttcctccgagtatg

SEQ ID NO: 528879 - DNA, 510 bp, Homo sapiens
  misc_feature: HEFZJCU01CBUDL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttggaggacgcctgacatctgacgacacgggccgtctattactgtgcgagacgtcccacgatccgggtagagtcctacggcagcggctttgacttcgtc

SEQ ID NO: 528880 - DNA, 494 bp, Homo sapiens
  misc_feature: HEFZJCU01D5Q3S.3.34.D01.1.454.heavy.3.raw
  modified_base (406)..(406): a, c, t, g, unknown or other
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtnttccccctggcaccctcctccaagagcacctctgggggcacagcggccctgggctgcctggtcaaggactacttccgacgtgcgtcgt

SEQ ID NO: 528881 - DNA, 501 bp, Homo sapiens
  misc_feature: HEFZJCU01B15QV.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtggctccatccgtccttactactggagctggctccggcagcccccagggaagggactggagcatattgggtatgtctttcacagtgggaggactggactacaacgcctccctcaggagtcgggtcaccatatcagtagacacgtccaagagccagttctcctgaagctgagggctgtgagcgccgcagacacggccgtgtattactgtgcgagactggccgcaacacgactacggtggcaactctatgtcttttgatatcgtgggcaagggact

SEQ ID NO: 528882 - DNA, 553 bp, Homo sapiens
  misc_feature: HEFZJCU01D7OJ0.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagagtcgagtaacgatctcagtggacacgtctaacaatcacctctccctgaggctgagctctgtgacagccgcggacacgggcgtttattactgtgcgagagggggacggactacgggtgtacgtacgttggggggttacgacccccgttgggggcccgaaggggaaaccccttgggtacctacccggtctcccttccacggcccctt

SEQ ID NO: 528883 - DNA, 513 bp, Homo sapiens
  misc_feature: HEFZJCU01C6NIR.9.64.F09.1.454.heavy.3.raw
tgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagaagtcctatgtggactctgtgaagggtcgattcatcatctccagagacaacgccgagaactccctgtatctgcaaatgaacagcctgagagtcgaggacacggctatgtattattgtgtgacgtgaataaaagtggggccagggtaaccctggtcacgtctcctc

SEQ ID NO: 528884 - DNA, 505 bp, Homo sapiens
  misc_feature: HEFZJCU01C3XCY.18.39.D06.1.454.heavy.3.raw
  modified_base (469)..(469): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgcctgctccaggagcactctggggcacngcggccgtggctgcctggtcaggactactcccatac

SEQ ID NO: 528885 - DNA, 539 bp, Homo sapiens
  misc_feature: HEFZJCU01BZUCQ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacgacgggcttctacttctgtgcgagagtaattactataacactgcttcctttttacaccttcccttgtaccttcgtggggtccagtcggtaaccccggtccg

SEQ ID NO: 528886 - DNA, 495 bp, Homo sapiens
  misc_feature: HEFZJCU01BFXQJ.9.76.G10.1.454.heavy.3.raw
  modified_base (464)..(464): a, c, t, g, unknown or other
tgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggccaggggactggagtgggtggcacttatatcatatgatggaattaaaaatactatgcagactccgtgaaggccgattcaccatctccagagacactccaagaacacgctgtttctgcaaatgaacagcctggacgagctgagacgacggctgtgtatttctgtnctcaagataggtggacttcgatttcgttgga

SEQ ID NO: 528887 - DNA, 492 bp, Homo sapiens
  misc_feature: HEFZJCU01D735J.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggccagggaaccctggtcaccgtctcctcagcctccaccaaggcccatcggtcttcccctggcaccctcctccaagagcacctctggggcacagcggccctgggctgcctggtcaaggactactccgagtagtaca

SEQ ID NO: 528888 - DNA, 500 bp, Homo sapiens
  misc_feature: HEFZJCU01EJGGC.9.81.H04.1.454.heavy.3.raw
tgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactctcctgtgccgcctctggattcatgtttgatgattatgccatgcactgggtccggcaagttccagggaaggcctggagtgggtctcaggtattacttggagtagcactaccacaggctatgcggactctgtgaggggcgattcaccatctccagagacaacgccaagaactccctatatctgcaaatgaatggtctgagagttgaggacacggccttgtattactgtgacaaaagataggaaacccaggtggacg

SEQ ID NO: 528889 - DNA, 539 bp, Homo sapiens
  misc_feature: HEFZJCU01C298R.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattccaagtccgcgggggtcacccaaattgactactggggccagggaacccgtggtcaccgtctcctcagcctccaccaacgggcccagtccggtccttcccccgtcggccgcccgtcgtcctccgtac

SEQ ID NO: 528890 - DNA, 508 bp, Homo sapiens
  misc_feature: HEFZJCU01CKJ26.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggccctggacaaggacttgagtgggtgggtggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtagacgtggtagttccggggggacgacgatagacaccg

SEQ ID NO: 528891 - DNA, 530 bp, Homo sapiens
  misc_feature: HEFZJCU01CIW1D.40.67.G01.1.454.heavy.3.raw
  modified_base (346)..(346): a, c, t, g, unknown or other
tctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctgggatcccgccagcccccaggaaaggggctccaatgcgttggacatgtcaattcttatgggcgctcccactacagtgcggccctccagngtcgagccctcatatccatagacacgtccaagaaccagttttccctgacgctgacgtctgtgaccgccgcagacacggctgtctattattgtgcgagactagccttctgtagtgggggtacttgcaacccgggatactactccaccttcggctttggacatcgtggggtccggagggggccgtc

SEQ ID NO: 528892 - DNA, 491 bp, Homo sapiens
  misc_feature: HEFZJCU01CM54T.48.71.G05.1.454.heavy.3.raw
agtatacatacacgaccggtgctcgatttagtgtcgtcgcaagagagagggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcaccttatggcggacgaatcctcgagcacagtctatatggatctggccagcctgaagtctgaagacacgggcatatatttctgtgcgacagatggtcgtggattctcgtctgcttatgga

SEQ ID NO: 528893 - DNA, 536 bp, Homo sapiens
  misc_feature: HEFZJCU01EECEG.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttattggggccagggagccctggtcaccg

SEQ ID NO: 528894 - DNA, 524 bp, Homo sapiens
  misc_feature: HEFZJCU01AUYTZ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattttgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctaactcggccaatactatgggggcttgttctgggggccaggggaccctggtcatcgtctccccagcctccaccaagggccatcggtcttcccctgcg

SEQ ID NO: 528895 - DNA, 503 bp, Homo sapiens
  misc_feature: HEFZJCU01BDFIQ.51.34.D01.1.454.heavy.3.raw
  modified_base (369)..(369): a, c, t, g, unknown or other
cgatcgtatacacgaccggtgctcgatttagatcgtctgtgttgggtttggggtctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactacgctatcgattgggtccgccaggctccaggcaagggactggagtgggtggcagttatttcagctgatggaggcaataagttttacgganattctgcgaggggccagttcaccatatccagagacaactcccaagatatgatatatctgcaaatgaacagcctgacgacctgaggacacggctatgtattattgtgcgtgagggggcaggtgcgtggccacgtg

SEQ ID NO: 528896 - DNA, 494 bp, Homo sapiens
  misc_feature: HEFZJCU01EXXG2.11.38.D05.1.454.heavy.3.raw
cgagagataccacgaccggtgctcgatttagtatctgatagttgggtctgggggaggcttggtacagcctggggggtccctgagactctcctgtgcagcgtctggattcacctttagcagctatgcccccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttccccctggcaccctcctccaagagcacctctgggggcacagcggccctgggctgcctggtcaaggactacttcctatctctcg

SEQ ID NO: 528897 - DNA, 505 bp, Homo sapiens
  misc_feature: HEFZJCU01EOY0E.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgt

SEQ ID NO: 528898 - DNA, 423 bp, Homo sapiens; identical to SEQ ID NO: 446550
  misc_feature: HEFZJCU01EFZ3Z.11.22.B11.1.454.heavy.3.raw

SEQ ID NO: 528899 - DNA, 513 bp, Homo sapiens
  misc_feature: HEFZJCU01BCLLY.17.33.C11.1.454.heavy.3.raw
cgtagactagcacgaccggtgctcgatttagagtgagctcgttgggtttgggggactcctgtgccccaccatggacacactttgctccacgctccctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctatttgactactggggccagggaactctggtcaccgtctccgcagcctccaccaagggccc

SEQ ID NO: 528900 - DNA, 331 bp, Homo sapiens
  misc_feature: HEFZJCU01AOM89.48.29.C07.1.454.heavy.3.raw
agtatacatacacgaccggtgctcgatttagagtgctacgaagggggggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggccttccgggagaggg

SEQ ID NO: 528901 - DNA, 543 bp, Homo sapiens
  misc_feature: HEFZJCU01CM5SX.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtgcggccgggggggtccctgagactctcatgtgcagggtctggattcaacttttacgattatggcatgacctgggtccgccaagctccagggaagggctggagtgggtctctggtctgaattggaatggtgatagtatagattatgcaggctctgtgaggggccgattcaccatctccagagacaacgccaagaactccctgtttctgcaaatggacaatttgagagaggaagacacggcctttatatttctgttgcgagagccccttcgggccaggaacgttctgggtactacctacttaacgtttatacggttatcgggtacgttcc

SEQ ID NO: 528902 - DNA, 493 bp, Homo sapiens
  misc_feature: HEFZJCU01CV6HU.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtggtttccgtcgttaggctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 528903 - DNA, 510 bp, Homo sapiens
  misc_feature: HEFZJCU01CDFLD.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacggaactcctccataaacacagcctacatggagttgaggagcctgacatctgacgacacgggccgtctattactgtgcggagagtcccacgatccgggtgacgcctacggcaggccggcctttgacttctc

SEQ ID NO: 528904 - DNA, 508 bp, Homo sapiens; identical to SEQ ID NO: 489428
  misc_feature: HEFZJCU01C0N4R.12.78.H01.1.454.heavy.3.raw

SEQ ID NO: 528905 - DNA, 483 bp, Homo sapiens
  misc_feature: HEFZJCU01EJLMB.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacaccgtccatcagccacgtccatcacgcacagcctacatggacctgagcggcctgacatctgacgacacggccgtattatttctgtgcgaggg

SEQ ID NO: 528906 - DNA, 503 bp, Homo sapiens
  misc_feature: HEFZJCU01ERVIF.7.85.H08.1.454.heavy.3.raw
  modified_base (446)..(446): a, c, t, g, unknown or other
  modified_base (481)..(481): a, c, t, g, unknown or other
cgtgtctctacacgaccggtgctcgatttagtatcactcagtcgcggggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatgaacagcctgagngtcgaggacacggctgtgtattactgtgcgagagntccgggagggggacgtatgacc

SEQ ID NO: 528907 - DNA, 510 bp, Homo sapiens
  misc_feature: HEFZJCU01ATP1I.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaaccacagacacatccacgagcacagcctacatggaactgaggagcctgagatactgacgacgacggccgtatatttctgcgcgagagacgtaaaagtgacgtggtagtccggggggacgacatgactacc

SEQ ID NO: 528908 - DNA, 530 bp, Homo sapiens
  misc_feature: HEFZJCU01EG16Y.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagccctccgaccaagggcccatcggtcttcccctcggccgcctcg

SEQ ID NO: 528909 - DNA, 509 bp, Homo sapiens
  misc_feature: HEFZJCU01BOG2O.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttccccctggccaccctcctccaagagcacctctgggggcacagcggccctgggctgcctggtcaaggactacttccgagtgcgtct

SEQ ID NO: 528910 - DNA, 511 bp, Homo sapiens
  misc_feature: HEFZJCU01DXQYE.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgcctgctcaggagcacctctggggcacagcggccctgggcgtgcctggtcaaggactacttccccataccg

SEQ ID NO: 528911 - DNA, 538 bp, Homo sapiens
  misc_feature: HEFZJCU01BLRSV.49.78.H01.1.454.heavy.3.raw
  modified_base (460)..(460): a, c, t, g, unknown or other
  modified_base (504)..(504): a, c, t, g, unknown or other
agtcgagagacacgaccggtgctcgatttagtgtgagtagtttgggtttggggaatgactctagaagtctcccacatctgacctttctgggtggaggcaggtggtggccctgggaatataaaaatctccagaatgatgactctgtgatttgtgggcaacttatgagcccgaaaggacatggccacggggtgggtagggacatagggccagatgccagcctgaggtggagcctcaggtcacaggtgggcacggacactatccacataagcgagggatagacccgagtgtccccacagcagacctgagagcgctgggcccacagcctccccctcacgagccctgctgcctcctcccggtcagcccctggacatccccaggtttcccccaggcctggcggtaggtttagaatgaggtctgtgtcactgtggtattacgatattttgactggtttggatgactnttacttctacttctacgttatggacctctgggggcaagggaccncggtcaccgtcctctcagcctccaccaagggccc

SEQ ID NO: 528912 - DNA, 541 bp, Homo sapiens
  misc_feature: HEFZJCU01CLDWH.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtggctgttataacttctgatggagggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtcgtggggccgaagggaccacggtcacccgtctccttagcctccaccaaaggggcccatcggtctttccccctggcaccctcctccaagagcacctctc

SEQ ID NO: 528913 - DNA, 513 bp, Homo sapiens
  misc_feature: HEFZJCU01ELVLD.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccggtgacgcctacggcagcggctttggacttctgggggcccaggggacg

SEQ ID NO: 528914 - DNA, 527 bp, Homo sapiens
  misc_feature: HEFZJCU01EJ3V7.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactaatgggggcttgttctggggccaggggaccctggtcatcgtctccccagcctccaccaagggacccacgtcggtccttcccctggccg

SEQ ID NO: 528915 - DNA, 503 bp, Homo sapiens
  misc_feature: HEFZJCU01BZCMH.17.10.A10.1.454.heavy.3.raw
  modified_base (470)..(470): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtanaatttgataggctactatggactggacttcgtc

SEQ ID NO: 528916 - DNA, 412 bp, Homo sapiens
  misc_feature: HEFZJCU01D7KV4.48.81.H04.1.454.heavy.3.raw
  modified_base (405)..(405): a, c, t, g, unknown or other
agtatacatacacgaccggtgctcgatttagtagtgtagattcgcgggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatctatccctttctctaatgtcacaagatacacacagagattccagggcagaatcacacttaccgcggacaaatccacgggcacagcgnagttgga

SEQ ID NO: 528917 - DNA, 504 bp, Homo sapiens
  misc_feature: HEFZJCU01ET40A.3.26.C04.1.454.heavy.3.raw
  modified_base (368)..(368): a, c, t, g, unknown or other
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctntggggccgtggcacctgctgactgtctcctcagcctccaccgaacgggcccatcggtcttcccctggccgccctgctccaggagcacctccgagacgcacagccgcccgtcggcgtcgcctggtcaaggacctacg

SEQ ID NO: 528918 - DNA, 524 bp, Homo sapiens
  misc_feature: HEFZJCU01D5S9U.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgacctagtgggccggggaacccgtggtcaccgtctcttcagcctccaccaagggcccatcggtcttccccgtggccaccctcctccaagacgcacctctcgggggcacagcc

SEQ ID NO: 528919 - DNA, 524 bp, Homo sapiens
  misc_feature: HEFZJCU01CJE52.12.40.D07.1.454.heavy.3.raw
atacgacgtacacgaccggtgctcgatttagtgatagagcgtaacaacagagggctcaccatggagtttgggctgagcgtgggttttccgtcgttaggctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttccccgtgcg

SEQ ID NO: 528920 - DNA, 500 bp, Homo sapiens
  misc_feature: HEFZJCU01DYTUM.17.25.C03.1.454.heavy.3.raw
  modified_base (484)..(484): a, c, t, g, unknown or other
  modified_base (495)..(495): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggnagcggcctttnacttc

SEQ ID NO: 528921 - DNA, 521 bp, Homo sapiens
  misc_feature: HEFZJCU01DNT77.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcacctggtcactgtctcctcggcttccaccaacgggcccatcggtccttcccctggccgccctcgctccacggagcacctcgtcgggggcgacagcggcccg

SEQ ID NO: 528922 - DNA, 506 bp, Homo sapiens
  misc_feature: HEFZJCU01EYLBF.17.10.A10.1.454.heavy.3.raw
  modified_base (462)..(462): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaaccacagtctacatgcaactgacgagcctgagagctgacgacacggccgtctattactgtgcgagaattgttttcngtcatcgtaactatttgataggctctatggactggacttcgtac

SEQ ID NO: 528923 - DNA, 532 bp, Homo sapiens
  misc_feature: HEFZJCU01DLEXS.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcagtttacttgacccctgggggcccggggaaccctggtccaccgtctccccacctccaccg

SEQ ID NO: 528924 - DNA, 540 bp, Homo sapiens
  misc_feature: HEFZJCU01D5RRC.7.78.H01.1.454.heavy.3.raw
cgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataacctaaccttcaacctgacgacactgccgtttatttttgtacgagagcgtcgtctgtcagtggtaattgactacgtggggccagggaacccgtggtcaccgtctcctcagcctccaccaacggggccc

SEQ ID NO: 528925 - DNA, 517 bp, Homo sapiens
  misc_feature: HEFZJCU01BOG88.4.26.C04.1.454.heavy.3.raw
agcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccctgagactctcctgtacagactctggattcgacctttagcagccatgccatgagctgggtccgccaggctccaggaaggggctggagtgggtctcagcaattagtggaggtggtggtggtggtacatactacgcaaactccgtgaggggccgattcaccatcctccagagacaattccaagaacacgttatatctgcaaatgaacagcctgcgagccgacgacacggccggtactattactgtgcgaaatgcctttattgtcgaccgaggcgtagcc

SEQ ID NO: 528926 - DNA, 520 bp, Homo sapiens
  misc_feature: HEFZJCU01B0OH0.12.58.F03.1.454.heavy.3.raw
  modified_base (432)..(432): a, c, t, g, unknown or other
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctgggattcactctcggaaacttttggatggtctgggtccgccaggctccagggaagggctggagtgggtggccaatatacagtcaggtggaggtacgatacactatctcgactctgtgaagggccggttcaccgatctccagagacaacgccaagaattcactgtatctgcaatnaacagcctgagagtcgaagacacgggtatttagttattgtgtgcgagatctggatttccttcgaatgaagtgtggttcgatgtgtttg

SEQ ID NO: 528927 - DNA, 510 bp, Homo sapiens
  misc_feature: HEFZJCU01BQJ97.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacgatttctagtaattctggtaccatacactatgcagtctctgtgaagggccgattcaccatcctccagagacaacgccaggaactcactttatctgcaaatgagcagcctgagaggtcgaggacacgggtatttattactgtgtcgagagatagtctgtctatgtcgttcccgggagtactaa

SEQ ID NO: 528928 - DNA, 514 bp, Homo sapiens
  misc_feature: HEFZJCU01DI49S.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagtttattggatgactttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtacttactgtgcgagagtttcttgggtatgttgtcggttgcacc

SEQ ID NO: 528929 - DNA, 508 bp, Homo sapiens
  misc_feature: HEFZJCU01BAHVT.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgcaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacagtattactgtgcgaaacgatctcgggctggttccgcggtccgggt

SEQ ID NO: 528930 - DNA, 523 bp, Homo sapiens
  misc_feature: HEFZJCU01CI6JG.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcacatctccagggcaacgccaagaactcactgacttgcaaatgaacaccctgcgagccgaggacacggtccgtatacttactgtgcgaggaactaacccgttcgccttggttatttaccg

SEQ ID NO: 528931 - DNA, 529 bp, Homo sapiens
  misc_feature: HEFZJCU01C06M5.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcaatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggcatatattactgtgcgagaaggtacggttttgggggcgcggactcctcttgagatcgtggggccagggggacaagtcggtcaccgtctcctttcagt

SEQ ID NO: 528932 - DNA, 532 bp, Homo sapiens
  misc_feature: HEFZJCU01BH2A9.52.55.E11.1.454.heavy.3.raw
cgcagtacgacacgaccggtgctcgatttagcactcgcacgttgggtttggggaaccagattcctcctctaaagaagcccctgggagcacagctcatcaccatggactggacctggaggttcctctttgtggtggctgcagttacagctgtccagtcccaggtccacctggtgcagtctggggctgaagtaaagaagcctgggtcgtcggtgaaggtctcctgcagggcctctggagccaccttcggcacttatgggatcagctgggtgcgccaggcccctggacaaggggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgttttactgttgcgagatttacagtctcgcccacaacttctggtggcggcggtgttcaccttctactttgactcctggggccagggaaccctggt

SEQ ID NO: 528933 - DNA, 468 bp, Homo sapiens
  misc_feature: HEFZJCU01C8Y41.48.59.F04.1.454.heavy.3.raw
agtatacatacacgaccggtgctcgatttagtacacacacttagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggccaccctcctccaagagcacctctgggggcacagcggccctgggctgcctggtcaaggactacttcctatgtatact

SEQ ID NO: 528934 - DNA, 512 bp, Homo sapiens
  misc_feature: HEFZJCU01B5TZY.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttggaggagcctgacatctgaccgacacggccgtctattactgtgcgagacgtcccacgagtcccggtgagcccgtacggccagcggcctttgacttcgtc

SEQ ID NO: 528935 - DNA, 510 bp, Homo sapiens
  misc_feature: HEFZJCU01ES7WC.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacggtccatcgccacgacttacatggaactgaccagtctgacatttgacgacacggccgtctattactgtgcgacagaagcgggcggaacagaggttcgcttactggtttcggaggc

SEQ ID NO: 528936 - DNA, 512 bp, Homo sapiens
  misc_feature: HEFZJCU01DAEDK.52.78.H01.1.454.heavy.3.raw
cgcagtacgacacgaccggtgctcgatttagtgtgagtagtttgggtttgggaccggtgctcgattcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctcgtgggccgtggcaccctggtcactgtcttctcagcctccaccaacgggcccacgtcggtccttccccctcggccacccctcctccaaga

SEQ ID NO: 528937 - DNA, 396 bp, Homo sapiens
  misc_feature: HEFZJCU01BE2WA.47.46.E02.1.454.heavy.3.raw
  modified_base (392)..(392): a, c, t, g, unknown or other
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtnagct

SEQ ID NO: 528938 - DNA, 512 bp, Homo sapiens
  misc_feature: HEFZJCU01AU6WZ.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactattggactctgtgaggggccgattcatcatctccagagacaacgccgacaactcactgtctctgctgatgagcagcctgagagccgacgacacggctatctattactgtgcgaaactctcattccgttcatctgaatactggggccaggggaaccctggtccgtccg

SEQ ID NO: 528939 - DNA, 402 bp, Homo sapiens; identical to SEQ ID NO: 444815
  misc_feature: HEFZJCU01EP1UE.11.70.G04.1.454.heavy.3.raw

SEQ ID NO: 528940 - DNA, 508 bp, Homo sapiens
  misc_feature: HEFZJCU01ANTOY.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgaggtgggtggggtgggtcagcgcttaccaagttgggctacacaaattatgcacagaagttccaggacagagtcaccatgaccacagacacatccacgagcacagcctacatggaactgaggagcctgagatctgacgacacggccgtactatttctgcgcgagagacgtaaagtgacgtggtagttcggggggacacatgacaccg

SEQ ID NO: 528941 - DNA, 516 bp, Homo sapiens
  misc_feature: HEFZJCU01A3WQ1.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacaacgtccatcaacacagcctaccatggaactgaggagcctaagatactgacgacacggccgtttattattagtgcaaataagtaattgcaaacgatagtcgttttgattatgtggggtccgaagggactacg

SEQ ID NO: 528942 - DNA, 541 bp, Homo sapiens
  misc_feature: HEFZJCU01BBCCB.48.86.H09.1.454.heavy.3.raw
agtatacatacacgaccggtgctcgatttagtgctatagacttgggtttgggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcggaggccccgagcgcacgtggtctttttgtattgtcctttgtacttagtgttgggggtaccgaaacgggggtaaccaaagttggtaccgtacccggttcttccgtttcctaacggtccct

SEQ ID NO: 528943 - DNA, 531 bp, Homo sapiens
  misc_feature: HEFZJCU01EDINV.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaacgggcccatcggtcttcccctggccgcctcgctccaggagcacctccgagacgcacacgcggcccgtgggtcg

SEQ ID NO: 528944 - DNA, 502 bp, Homo sapiens
  misc_feature: HEFZJCU01CUJ6L.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaattgttttctgtcatcgtacaatttgataggctctatggactggcttcgtc

SEQ ID NO: 528945 - DNA, 521 bp, Homo sapiens
  misc_feature: HEFZJCU01EC23K.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctggggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaatgaacagcctgagagctgaggacacggctgtgtattactgttcgtttggttctgactcggtcgggggtaataccttctagcacgtggggccgac

SEQ ID NO: 528946 - DNA, 536 bp, Homo sapiens
  misc_feature: HEFZJCU01EX5GO.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtcgggttcggggacctcacccgtggttccttacgttacgtatcctcgtgggggccgtc

SEQ ID NO: 528947 - DNA, 509 bp, Homo sapiens
  misc_feature: HEFZJCU01B9V00.11.57.F02.1.454.heavy.3.raw
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcagtagtggtgcgaccatatactacgcagactctgtgaagggccgattcatcatctccagagacaatggcaacaactcactgtactctaggaaatcaaacagcctgagagtcgaggacacgg

SEQ ID NO: 528948 - DNA, 514 bp, Homo sapiens
  misc_feature: HEFZJCU01ADKJ6.40.35.D02.1.454.heavy.3.raw
tctagcgactcacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgtattgcctttgattatgtgggggtccaaggggacaatggtcaccgttccg

SEQ ID NO: 528949 - DNA, 540 bp, Homo sapiens
  misc_feature: HEFZJCU01AQP65.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaataggctgtgtttattggggtccaggggagcccgtggtctaccg

SEQ ID NO: 528950 - DNA, 496 bp, Homo sapiens
  misc_feature: HEFZJCU01EYG5E.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagtacttttcagggctgggtcaccatgaccagcgacacatctagcaacacagtctacatggagttgaccagcctcgaccgacgacggccgtgttatttttgtgtgagagtattttcggacaatccagacgacccctgtc

SEQ ID NO: 528951 - DNA, 517 bp, Homo sapiens; identical to SEQ ID NO: 463775
  misc_feature: HEFZJCU01AFK55.11.13.B02.1.454.heavy.3.raw

SEQ ID NO: 528952 - DNA, 505 bp, Homo sapiens
  misc_feature: HEFZJCU01BQUHL.9.33.C11.1.454.heavy.3.raw
tgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtaggcagctccaagtactacttt

SEQ ID NO: 528953 - DNA, 548 bp, Homo sapiens
  misc_feature: HEFZJCU01BVG9U.13.65.F10.1.454.heavy.3.raw
tcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtggggtctcagttatttatgtcgacggtgccacattctacgcagactccgtgaggggccggttcaccatctccagagacaattccaagaacacggtgtatcttcaaatgaacgacctgagagtcgaggacacggccgtctattactgtgcgaaagatgcagagagggaccccgtaagtcggggcctgggtgggagggttcttctttgtactgcgtggggccaggggaacccgtc

SEQ ID NO: 528954 - DNA, 514 bp, Homo sapiens
  misc_feature: HEFZJCU01CAFWD.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcaactttatctgcaatgaacagcctgagaaccgacgacacggccgtctattattgtgtcatagacctaggatacaacgacggtggtacctggt

SEQ ID NO: 528955 - DNA, 406 bp, Homo sapiens
  misc_feature: HEFZJCU01B45ZS.49.43.D10.1.454.heavy.3.raw
agtcgagagacacgaccggtgctcgatttagactagcagtaagggctggagtgggtctctgccattagtggaagtggtgatctcagatactacggagactccgtgaagggccggttcaccatctccagagacaactccaagaatacgctctatctacacatgaaaacctaagagccgacgacacggccgtctattactgtgcaaagtgggtcatggactacgatgatactagtggctattactccggtgactactttgactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 528956 - DNA, 509 bp, Homo sapiens; identical to SEQ ID NO: 445824
  misc_feature: HEFZJCU01ASA9B.9.14.B03.1.454.heavy.3.raw

SEQ ID NO: 528957 - DNA, 515 bp, Homo sapiens
  misc_feature: HEFZJCU01DSPU8.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggccatcgtcttcccctggcaccctcctccagagcacctctcgggggcacagcggccctggcctgcctggtcaaggactacttcctagagacacg

SEQ ID NO: 528958 - DNA, 530 bp, Homo sapiens
  misc_feature: HEFZJCU01BSZPC.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaattgactactgggccgagggaaccctggtcaccgtctcctcacgcctccaccaacgggcccatcggtccttccccctcggccgccctcgctccac

SEQ ID NO: 528959 - DNA, 500 bp, Homo sapiens
  misc_feature: HEFZJCU01EBCEL.40.81.H04.1.454.heavy.3.raw
tctagcgactcacgaccggtgctcgatttagtagtgtagattcgcgggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatgggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggtagagacgttggtgctaccggcggggctgaccacgtggggccg

SEQ ID NO: 528960 - DNA, 543 bp, Homo sapiens
  misc_feature: HEFZJCU01DKYHU.13.24.C02.1.454.heavy.3.raw
tcacgtactacacgaccggtgctcgatttagtacagatcgttagggaaaggggctgggagaggagccccagccctgagattcccaggtgtttccattcagtgatcagcactgaacacagaggactcaccatggagttgggactgagctggattttcctttttggctattttaaaaggtgtccagtgtgaagtgcagctggtggagtctgggggaggcttggtacagcctggcgggtccctgagactctcctgtgtagtttctgggctcacgtttgttgatcgtgccatgcactgggtccgccaaagtccagggaagggcctggagtggggtctcaggtatttatgggaacagtgaaagaatagggtatgcggactctgtgaagggccgattcaccatctccagagacaacgccaagaactccctctttttgcaatgaacagtctgaaaactgaggactcggccttatattactgtctcaaagaaagtaataaatgggggtctcgactactggggcccaggggagccctggtcacgtctcctcg

SEQ ID NO: 528961 - DNA, 510 bp, Homo sapiens
  misc_feature: HEFZJCU01EEWFL.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggccccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgactacacggccgtatatttctgcgcgagagacgtaaagtagacgtggtagttccggggggacgacatgactaccg

SEQ ID NO: 528962 - DNA, 514 bp, Homo sapiens
  misc_feature: HEFZJCU01BTKSP.21.23.C01.1.454.heavy.3.raw
tcgtcgctcgcacgaccggtgctcgatttagtacacgtgattagggattggggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaatgaacagtctgagagccgaggacacggctgtgttattactgtgacaaggccccagaacctggaactacggccatggacgtcgtgggcgaaac

SEQ ID NO: 528963 - DNA, 495 bp, Homo sapiens
  misc_feature: HEFZJCU01AOJM2.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccacgttctccctgcagctgaccttctgtgactcccgaggaccgacgggtgtatattaatcgtgggtaagacggcccccatagacatgccacctccgtctctggtgctta

SEQ ID NO: 528964 - DNA, 513 bp, Homo sapiens
  misc_feature: HEFZJCU01BPSNF.17.25.C03.1.454.heavy.3.raw
  modified_base (445)..(445): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtntattactgtgcgagagtcccacggatccggtgacgcctacgggcaggccggccttttggacctttctc

SEQ ID NO: 528965 - DNA, 511 bp, Homo sapiens
  misc_feature: HEFZJCU01BSLUM.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggccccccggacacagccttgagtggatgggatggatgaacgttgacaatgggaatacgagatattcacagaaattccagggcagagtcaccattaccagggacacatccgcgaacacagcctacatggagctgacgggcctgacatctgaagacacggctttatatttactgttgcgacgagatggctgggcacagagggcacgaactggcctcgaccccg

SEQ ID NO: 528966 - DNA, 485 bp, Homo sapiens
  misc_feature: HEFZJCU01D0OXW.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcctttttgaccagtggggccagggaaccctggtcaccgtctcctcagcttccaccaagggcccatcggtcttcccctgcgccctgctccaggagcactctggggcacagcgcctggctgcctgtcaaggactacttccctacagtgct

SEQ ID NO: 528967 - DNA, 514 bp, Homo sapiens
  misc_feature: HEFZJCU01BZYCS.53.36.D03.1.454.heavy.3.raw
cgcgtatacacacgaccggtgctcgatttagctgcgtcacgatctctcttgggggctctgggagaggagccccagccgtgagattcccaggagtttccacttggtgatcagcactgaacacagaccaccaaccatggagtttgggcttagctgggttttccttgttgctattttaaaaggtgtccaatgtgaggtggaactggtggagtctgggggaggcttggttcagccagggcggtccctgagactctcctgtacaacttcaggattcacctttggtgattatgctatgacctgggtccgccaggctccagggaaggggctggagtgggtaggtttcgttagaagcaaaactgatggtgggacaacagaatacgccgcgtctgtgaaaggcagatttatcatctcaagagatgattccagaggcatcgcctatctgcaatgaacagcctagaaaaccgaggacacagccgtgtatttctgtactagagtcttcttgtattactatgatact

SEQ ID NO: 528968 - DNA, 508 bp, Homo sapiens
  misc_feature: HEFZJCU01EOU6Y.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgaggcagtgttcaatggtatgcagactccgtgaagggccgattcaccatctccagagacattccaggaacacaatgtattggagctgaacagcctaagtcctgaggacacgggcgtatactactgtacgaggaagggggaacgagcgggagtcgagtactacttgtacg

SEQ ID NO: 528969 - DNA, 486 bp, Homo sapiens
  misc_feature: HEFZJCU01APKWJ.51.27.C05.1.454.heavy.3.raw
  modified_base (459)..(459): a, c, t, g, unknown or other
cgatcgtatacacgaccggtgctcgatttagacgcgatcgaagggtttggggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacncggctgtatattactgtgacgaactta

SEQ ID NO: 528970 - DNA, 519 bp, Homo sapiens
  misc_feature: HEFZJCU01CA62N.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaggtctcctgcgaggcttctggttacacctttctcaggtatactattgcctgggtgcgacaggcccctggacaagggcttgagtggatggggtggatcaacgtacagactggtggcacagactatgcacaggggctccagggcaggactcaccatgaccacagacacatcagcgaacacagtcaacatggagttgcggaggcctgcgatctgacgacgcggccgtatattactgtgcgagagtacggtagcggctcgtcctttgacttactggggcctggggaactctggtcaccgtctcc

SEQ ID NO: 528971 - DNA, 479 bp, Homo sapiens
  misc_feature: HEFZJCU01A0542.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggacctgacatctgacacacggccgtatatttctgtgcgaggg

SEQ ID NO: 528972 - DNA, 509 bp, Homo sapiens
  misc_feature: HEFZJCU01CXM2S.11.13.B02.1.454.heavy.3.raw
  modified_base (258)..(258): a, c, t, g, unknown or other
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtctcccctgccgccctgcctccaggagcaccctccgagagcacagcggccc

SEQ ID NO: 528973 - DNA, 511 bp, Homo sapiens
  misc_feature: HEFZJCU01DLC7Y.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtagtagcggctcgtcctttgactactggggcctgggactctggtcaccgtct

SEQ ID NO: 528974 - DNA, 514 bp, Homo sapiens
  misc_feature: HEFZJCU01BI6UY.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgtctctatggttcggggagttattagtcccttaactttgactactggggccagggaactctgtcaccgtctccgcagcctccaccaaggccc

SEQ ID NO: 528975 - DNA, 496 bp, Homo sapiens
  misc_feature: HEFZJCU01EXA5Q.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtcctacatggatctgagcggactgacctctgacgaccacggccatcgtattacttgtggaagagacgttggtggcgtaccgcggggctgaccac

SEQ ID NO: 528976 - DNA, 512 bp, Homo sapiens
  misc_feature: HEFZJCU01BFCVG.13.79.H02.1.454.heavy.3.raw
tcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagagttgggggcggaagggtataggcagtggcc

SEQ ID NO: 528977 - DNA, 515 bp, Homo sapiens
  misc_feature: HEFZJCU01C4ELS.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctcaccaaggcccatcc

SEQ ID NO: 528978 - DNA, 501 bp, Homo sapiens
  misc_feature: HEFZJCU01AFX8Z.13.85.H08.1.454.heavy.3.raw
  modified_base (496)..(496): a, c, t, g, unknown or other
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactattggagttgagcagcctgagatctgacgacacggtccgtttattactgtgcgcgagataatagtcacaactggaacggtcgttttggggnggttc

SEQ ID NO: 528979 - DNA, 509 bp, Homo sapiens
  misc_feature: HEFZJCU01BQ9VV.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaaggctggagtggcttggccgtattagaaccaaacctgacaagtacgcgacaatttatgctgcgtcggtgcaaggcaggttcaccatctccagagatgattcagagaacacggcgtatctgcaaatgaacagcctagaaaaccgaggacacggccgtgtattactgtgccagacatccgtcgtattacgtattttt

SEQ ID NO: 528980 - DNA, 512 bp, Homo sapiens
  misc_feature: HEFZJCU01CSN1K.4.67.G01.1.454.heavy.3.raw
  modified_base (345)..(345): a, c, t, g, unknown or other
agcactgtagcacgaccggtgctcgatttagagtatacatattgggtttgggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggnactggcgattatacatattatacagactccgtgaagggccgcttcaccatctccagagacaattccaagaacacggtgtatctgacaaatgaacagcctgagagccgaggacacggccacataattactgtgcgaaagatcgtcgggctggttccgtcgggtccggt

SEQ ID NO: 528981 - DNA, 571 bp, Homo sapiens
  misc_feature: HEFZJCU01C0KDB.49.27.C05.1.454.heavy.3.raw
agtcgagagacacgaccggtgctcgatttagacgcgatcgaagggggctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctgggggggggctggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgagggggccgattcatcatctccaaagactactccaagaatacggtgtatcttcaaatgaatggcctcgtttttgcggacacggctgtttattattgtgcggacgacggggggcccccctttccgtacggtacggcggacgtcatacgtaactttacgtacctacgtacggggtccgacgggtaacccgtcgggtaccg

SEQ ID NO: 528982 - DNA, 541 bp, Homo sapiens
  misc_feature: HEFZJCU01BC8UO.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatgggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttagttggggccaggggacgcccgtggtctaccg

SEQ ID NO: 528983 - DNA, 491 bp, Homo sapiens
  misc_feature: HEFZJCU01ERYSX.49.34.D01.1.454.heavy.3.raw
agtcgagagacacgaccggtgctcgatttagatcgtctgtgttgggtttggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttagaccactgcggccagggaaccctagtcaccgtctcctcagcctccaccaagggcccatcggtcttcccctggcaccctcctccagagcacctctgggggcacagcggccctgggctgcctggtcaaggactactcctctctcact

SEQ ID NO: 528984 - DNA, 520 bp, Homo sapiens; identical to SEQ ID NO: 447058
  misc_feature: HEFZJCU01C8TKU.9.34.D01.1.454.heavy.3.raw

SEQ ID NO: 528985 - DNA, 552 bp, Homo sapiens
  misc_feature: HEFZJCU01BMMX9.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactggtgcggagagggacggactacgggtgacgtactcgggggtttcgaccccgtgggggcccaggggaacccctgggtccaccggtccttccctcgtacgcccttacccaacccg

SEQ ID NO: 528986 - DNA, 512 bp, Homo sapiens
  misc_feature: HEFZJCU01EYVSF.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagccggcccgtcggggccttcgcctgggtcaagggactaacttcccttacgtcgtat

SEQ ID NO: 528987 - DNA, 497 bp, Homo sapiens
  misc_feature: HEFZJCU01BIQEN.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagagtgggaggtcgatagttgtta

SEQ ID NO: 528988 - DNA, 508 bp, Homo sapiens
  misc_feature: HEFZJCU01DTAEZ.51.6.A06.1.454.heavy.3.raw
cgatcgtatacacgaccggtgctcgatttagatctactgacagggggctgagctgggttttcctcgttgctcttttaagaggtgtccagtgtcaggtgcagctggtgcagtctggggggaggcgtggtccagcctgggaggtccctgagactctcctgtgaagcctctggattcagcttcagtacgtatggtttgcgctggggtccgccaggctccaggcaaggggactgcagtgggtggcatctatatcatatgaaggaagcaataaatactacgcagactccgtgaagggccgattcaccatctccagagacaatcccaagaacacactttatctgcaaatgaacaccctgagacttgaggacacggctgtctattattgtgcgagagggagatcgatcacagacagccctcgaacgaccagcatgagttggttttgatgtcgtggggccaaggggacaagtggtcgaccgtctcttcacgtcctccacccaacggggcccagtcc

SEQ ID NO: 528989 - DNA, 521 bp, Homo sapiens
  misc_feature: HEFZJCU01DOCEG.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattctgtgcgagagacccctccgatagcagtggctggtccactaggtttgactactggggccagggaagcgttggtcaccgtctcctcagccta

SEQ ID NO: 528990 - DNA, 512 bp, Homo sapiens
  misc_feature: HEFZJCU01C4MMF.17.33.C11.1.454.heavy.3.raw
  modified_base (318)..(318): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtntctgaagaacaggctcacatcaccaaggacacctccacaaaccaggtggtccttacaatgaccaatatggaccctgtggacacagcccacatattactgttcacgctctatggttcggggattattagtccctactttgactactggggccagggaactctggtcaccgtctccgcagcctccaccaaggcccc

SEQ ID NO: 528991 - DNA, 497 bp, Homo sapiens
  misc_feature: HEFZJCU01DJE87.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtggaagggccgattcaccatctccagagacaacttccaagaacacgcagtatctgcaaatgaacagcctgagagctgaggacacggctgtgtattacgtgtgggagagatggaggtcgatattggta

SEQ ID NO: 528992 - DNA, 503 bp, Homo sapiens; identical to SEQ ID NO: 450588
  misc_feature: HEFZJCU01BBKL8.13.33.C11.1.454.heavy.3.raw

SEQ ID NO: 528993 - DNA, 499 bp, Homo sapiens; identical to SEQ ID NO: 459022
  misc_feature: HEFZJCU01DQGL2.53.80.H03.1.454.heavy.3.raw

SEQ ID NO: 528994 - DNA, 512 bp, Homo sapiens
  misc_feature: HEFZJCU01AH07O.48.84.H07.1.454.heavy.3.raw
  modified_base (472)..(472): a, c, t, g, unknown or other
agtatacatacacgaccggtgctcgatttagcagacgtctgtcgcggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccattactactgtgcggcggggaggtggacggngccgttcgggtttcggaggtttactcagtctactaccttt

SEQ ID NO: 528995 - DNA, 532 bp, Homo sapiens
  misc_feature: HEFZJCU01DTS40.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaaggcccatcggtcttcccctggcgccctgctccaggagcacctcccgagacgcacacgcggcccgtcgggtccg

SEQ ID NO: 528996 - DNA, 548 bp, Homo sapiens
  misc_feature: HEFZJCU01EJ51K.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtgccaacataaagcaagatggaactgccgagttttacgtggactctgtgaagggccgtttcaccatctccagagacaacgccaagaattcactgtatctacaactgaacagcctgagagtcgcgagacacggccgtgtattactggtgcgagatggtaggaaaaagtatggtctgttggtttattgggggtaccaggggacgcccgtaggtcctaccg

SEQ ID NO: 528997 - DNA, 488 bp, Homo sapiens
  misc_feature: HEFZJCU01BC4XY.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggccagggtcaccgatggaccaggggacacgtccatcagcacgtccatcagcacagcctacatggacctgagcggcctgactatctgacgacacgggaccgtatatttctgtgcggagggagta

SEQ ID NO: 528998 - DNA, 518 bp, Homo sapiens
  misc_feature: HEFZJCU01AMHZ2.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtccaccatgtcagtggactcgtccaagagtgagttctccctgaggctgacgtctttaagtgtcgctgatacgggtgtctatttctgtgcgagactgcccggtcctgcacctcgtgtggcccctaatttcggtttaccggtcacacaaaatcagggcaagtcctacgacggtctggtacg

SEQ ID NO: 528999 - DNA, 500 bp, Homo sapiens
  misc_feature: HEFZJCU01DIG5Z.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacgacggtgtttattactgtagggagaaactcctagtggctacg

SEQ ID NO: 529000 - DNA, 396 bp, Homo sapiens
  misc_feature: HEFZJCU01A8Q1W.47.46.E02.1.454.heavy.3.raw
agctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggccgccctgctccaggagcacctccgagagcacagcggccctgggctgcctggtcaaggactacttcctacgtgagct

SEQ ID NO: 529001 - DNA, 499 bp, Homo sapiens
  misc_feature: HEFZJCU01B2BZC.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgacaaatgaacagacctgagagctggaggacacggctgtgtattactgtggggagagaatgggaggtcgatattgta

SEQ ID NO: 529002 - DNA, 521 bp, Homo sapiens
  misc_feature: HEFZJCU01CDAN8.49.53.E09.1.454.heavy.3.raw
  modified_base (452)..(452): a, c, t, g, unknown or other
agtcgagagacacgaccggtgctcgatttagagagagtgtgttgggtttggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggacgtgggtggcagtaatttcatatgattcaagtattggatattacgcagagtccgtaaagggccgattcaccatctccagagacaattcgaagaacaccatgtatctggaactgagcagagtcacatcngaggacacggactatgtattactgtgtgaaagtacttttatgacagtagtggtttctccgagtatgcaa

SEQ ID NO: 529003 - DNA, 534 bp, Homo sapiens
  misc_feature: HEFZJCU01BNUYM.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgaactggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaacgcgtcaactactactactacgtatggacctcgtc

SEQ ID NO: 529004 - DNA, 530 bp, Homo sapiens
  misc_feature: HEFZJCU01CDYUT.16.27.C05.1.454.heavy.3.raw
  modified_base (422)..(422): a, c, t, g, unknown or other
  modified_base (440)..(440): a, c, t, g, unknown or other
  modified_base (469)..(469): a, c, t, g, unknown or other
  modified_base (472)..(472): a, c, t, g, unknown or other
  modified_base (485)..(485): a, c, t, g, unknown or other
  modified_base (521)..(521): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggagcgttgtccagcctgggaggtcgttgagactctcctgtgaaggctctggattcacattcagtgactatggcatacactgggtccgccaggctccaggcaaggggctgaagtgggtggcgtttatttcatatgatggactactcaacactatccagactccggggagggccgattcaccgtctccagagacaattccaagaacagggtgtttcnccaagtgattgatctagngaagtgaggacacggctgtttatactgtncgnggtggctgaccgntctttgaccttactgggggcccgggaggccccggtnactcggtct

SEQ ID NO: 529005 - DNA, 499 bp, Homo sapiens
  misc_feature: HEFZJCU01DQN4M.21.40.D07.1.454.heavy.3.raw
  modified_base (463)..(463): a, c, t, g, unknown or other
tcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagacatactatgtggactctgtgaagggccgattcaccatctccagagacaacgccaagagctcactgtatctgcaatgaacagcctgagagtcgaggacacggctggtntatttacgtgtgcgtagagactcccctccggtatac

SEQ ID NO: 529006 - DNA, 522 bp, Homo sapiens
  misc_feature: HEFZJCU01DK6ZX.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagttccctactttgactactggggccaggggaactcgtggtcaccgtctccgccagcctccaccaagggccctatcc

SEQ ID NO: 529007 - DNA, 520 bp, Homo sapiens
  misc_feature: HEFZJCU01BXYBS.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgggtggtggagactggaggaggcttgatccagcctggggggtccctgagactctcctgtgcagcctctggcttcaccgtcagtagcagctacatgcactgggtccgccaggctccagggaaggggctgggagtgggtctcagttatttacaattctggtaccacatactactccgaccccgtgaagggccgattaaccatcctccagagacgattccgagaacacggtgtatcttcaaatgaacaacctgagagccgacgacacggccgtttattactgtgcgagagattcgagtggttcggggacctcaccctggttctacttcgatctct

SEQ ID NO: 529008 - DNA, 525 bp, Homo sapiens
  misc_feature: HEFZJCU01A9H92.14.57.F02.1.454.heavy.3.raw
cgtctagtaccacgaccggtgctcgatttagctcgatatagttgggtttggggctgagagaggagcccagtcctgggatcttcaggtgtttttcatttggtgatcaggactgaacagagagaactcaccatggagtttgggctgagttggctctttcttgtggctatttttaaaagatgtccagtgtgaggtgcagctgttggagtccgggggaggcttggtacagccgggggggtccctgacactctcctgtgcagcctcaggattcattttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaattggacagcctgaaagacgaagacacgggcgtgtatttttgtgttgaaagatacgaagtctatgataccaatttgggaggggcctttcat

SEQ ID NO: 529009 - DNA, 430 bp, Homo sapiens
  misc_feature: HEFZJCU01BEMNL.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatccaagcacacgcctacatgga

SEQ ID NO: 529010 - DNA, 501 bp, Homo sapiens
  misc_feature: HEFZJCU01EDETH.9.64.F09.1.454.heavy.3.raw
tgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaaggcctggagtgggtggccaacataaaggaagatggaagtgagaagtcctatgtggactcgtgtgaagggccgattcatcatctccagagacaacgccgagaactccctgtatctgcaaatgaacagcctgagagtcgaggacacggctatgtattattgtgtgagagaataaaaagtggggaccgagggaacccgt

SEQ ID NO: 529011 - DNA, 511 bp, Homo sapiens
  misc_feature: HEFZJCU01C4MZX.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcagagtacgtagcggctcggtcctttgactatggggcctgggaactctggtcacgtct

SEQ ID NO: 529012 - DNA, 503 bp, Homo sapiens
  misc_feature: HEFZJCU01CKXZN.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaaataaagactatgtggactccgtgaagggccgattcaccatctccagagacaactccaagaacactctgtttctccaaatgaacagcctgagaggcgaggacacggcaagtgtattactgtgcgagagatcgacatgactacgggaaagcttttgatctctggggccaagggacactggtcaccgtctcttcagcctccaccagggcccatcggttcctcccctggccgcctgctcc

SEQ ID NO: 529013 - DNA, 493 bp, Homo sapiens
  misc_feature: HEFZJCU01D228X.53.81.H04.1.454.heavy.3.raw
cgcgtatacacacgaccggtgctcgatttagtagtgtagattcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagcgggtggcagttatatcatttgatggaagcactacatactacgcaaactccgtgaagggccgattcaccatctccagagacgattccaggaacactctgtttctccaaatgaacagcctgagagctagagacacggtctctttattactgtgcgagagattctggataac

SEQ ID NO: 529014 - DNA, 510 bp, Homo sapiens
  misc_feature: HEFZJCU01EFEZG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagtcctacatggagttgaggagcctgacatctgacgcacggccgtctattactgtgcgagacgtcccacggatccgggtgacgcctacggcagcggtctttcgactttcgtc

SEQ ID NO: 529015 - DNA, 521 bp, Homo sapiens
  misc_feature: HEFZJCU01COBTB.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttcacctcccttgcttctgggcatggacccggt

SEQ ID NO: 529016 - DNA, 516 bp, Homo sapiens; identical to SEQ ID NO: 502300
  misc_feature: HEFZJCU01CHBGB.13.76.G10.1.454.heavy.3.raw

SEQ ID NO: 529017 - DNA, 544 bp, Homo sapiens
  misc_feature: HEFZJCU01DMVMW.13.36.D03.1.454.heavy.3.raw
tcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgaggacactgcctatttattatgtgtgagagtatttccttttccgttgtaccgttacggttacctttcttcgttcctttcggtactaccgttggggggcccgagggtaaaccccg

SEQ ID NO: 529018 - DNA, 517 bp, Homo sapiens
  misc_feature: HEFZJCU01CRIRJ.48.34.D01.1.454.heavy.3.raw
agtatacatacacgaccggtgctcgatttagatcgtctgtgttgggtttgggggcttttctgagagtcatggatctcatgtgcaagaaaatgaagcacctgtggttcttcctcctgctggtggcggctcccagatgggtcctgtcccagctgcggctgcaggagtcgggcccaggactggtgaagccttcggagaccctgtccctcacctgcactgtctctggtgctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgcctttgtatagtgtggggccgaaggggaccaagtggtacaccggtcctt

SEQ ID NO: 529019 - DNA, 530 bp, Homo sapiens
  misc_feature: HEFZJCU01D20JM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcttgggggccgagggggaccctggtcagtcgtctccccagcctccaccaacgggccacgtcggtcttccccctggccg

SEQ ID NO: 529020 - DNA, 505 bp, Homo sapiens; identical to SEQ ID NO: 520858
  misc_feature: HEFZJCU01CXAZH.17.10.A10.1.454.heavy.3.raw

SEQ ID NO: 529021 - DNA, 520 bp, Homo sapiens
  misc_feature: HEFZJCU01CW9BS.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctctttttatttatagtagtggtagtacatactccgcagactccgtgagggccgattcaaccatcctccagagacaattccaagaacacgctgttcttcaaatgaacagcctgagagccgatgacgacggccgtgtattactgtgcgagagatggggcccacgaacgttactacgctatggacgtctggggccaagggaccg

SEQ ID NO: 529022 - DNA, 508 bp, Homo sapiens
  misc_feature: HEFZJCU01AV6WA.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggcccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctccaaatgaacagcctgagaggcgaggacacggcagtgtattactgtgcgagagatcgacatgactacgggaaagcttttgatctctgggccaagggacactggtcaccgtctcttcacgcctccgaccaagggcccagtcggtcctttccccctggccgccctcgcctcc

SEQ ID NO: 529023 - DNA, 504 bp, Homo sapiens
  misc_feature: HEFZJCU01EG7YD.18.50.E06.1.454.heavy.3.raw
  modified_base (487)..(487): a, c, t, g, unknown or other
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaatgaacagcctgacagtcgacgacacggccatgtattttgtgcgagcgacccggggctccncaatggctttcattacg

SEQ ID NO: 529024 - DNA, 506 bp, Homo sapiens
  misc_feature: HEFZJCU01AWE35.53.61.F06.1.454.heavy.3.raw
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaagggggctggagtgggtggctacttatatcagatgatggaagtgatacatactatggagactccgtggaagggccgattcaccatctcgagagacaattccaggaacacgctgtatctgcaaatgaacggctgagagctgaggacacggctgtgtattactgtgcggtaaacggtttgaggtgggtaagtta

SEQ ID NO: 529025 - DNA, 520 bp, Homo sapiens
  misc_feature: HEFZJCU01DVQMV.53.57.F02.1.454.heavy.3.raw
  modified_base (337)..(337): a, c, t, g, unknown or other
  modified_base (446)..(446): a, c, t, g, unknown or other
  modified_base (475)..(475): a, c, t, g, unknown or other
cgcgtatacacacgaccggtgctcgatttagctcgatatagttgggtttgggtctgggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttntatcaaatgatggaagtaagaaatactatgtagactccgtgaagggccgattcaccatctccagagacaattccaagaatacgctgtatctgcacatgaacagcctganagccgaagacacggtgtttaatactgtgngtaacttaattacggaggtacgaacggtaacccccgtccgcgtac

SEQ ID NO: 529026 - DNA, 519 bp, Homo sapiens
  misc_feature: HEFZJCU01B06EW.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggcctccagggaaggggctggaatgggtctcgaggtattactggtggtggttataccacatactacgcagactccgtgaagggccggttcaccatcctccagagacaattccaagaacaacactgtatctgcaaatagaacagcctgagagccgacgacacggccatatattactgtgcgaaagccaccggcagttatcacccatacctactttgacttactcggggaccg

SEQ ID NO: 529027 - DNA, 379 bp, Homo sapiens; identical to SEQ ID NO: 444773
  misc_feature: HEFZJCU01B0CSL.3.59.F04.1.454.heavy.3.raw

SEQ ID NO: 529028 - DNA, 519 bp, Homo sapiens
  misc_feature: HEFZJCU01BLBB4.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgagttcaccatctcccagagacgattccaagaacacgttgtatcttcaatgaacagcctgacagtcgacgacacggccatgtatttttgtggtcgagccgacccggggcctcccgtcaagtggctttcatttaccgg

SEQ ID NO: 529029 - DNA, 519 bp, Homo sapiens
  misc_feature: HEFZJCU01B9OWD.48.81.H04.1.454.heavy.3.raw
agtatacatacacgaccggtgctcgatttagtagtgtagattcgcggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagaccgtgaggacacggccatttactactgtgtggtcgggggaggtgggacgggagcgtcgggttttcggaggtttatcacgtctactactttt

SEQ ID NO: 529030 - DNA, 507 bp, Homo sapiens
  misc_feature: HEFZJCU01BWZRX.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttctcaatgaacagcctgagagccgatgacacggccgtgttattactgtgcgagagagtggggcccacgaacgttaactacgtctatggacgtc

SEQ ID NO: 529031 - DNA, 533 bp, Homo sapiens
  misc_feature: HEFZJCU01DT71O.16.87.H10.1.454.heavy.3.raw
tgtactactccacgaccggtgctcgatttagcagtactgcgttgggtttgggggagcccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcgaaggcagttcgtggaaacagttatgggttggggggagttgggttttttttcgttacgtacgggt

SEQ ID NO: 529032 - DNA, 515 bp, Homo sapiens
  misc_feature: HEFZJCU01CEUW9.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtgcgtttattcatatgatggaactactcaacactatccagactccggggagggccgattcaccgtctccagagacaattccaagaacagggtgtttctcaagtgattgatctgagaagtgaggacacggctgtttattactgtgcgcggtggctgaccgctcttgactacgtgggggccgggagccccggt

SEQ ID NO: 529033 - DNA, 509 bp, Homo sapiens
  misc_feature: HEFZJCU01CDN29.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagtttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgagttcaccatctccagagacgattccaagaacacgttgtatcttcaatgaacagcctgacagtcgacgacacggccatgtatttttgtgtcgagcgacccggggctcctcaatggctttcattacg

SEQ ID NO: 529034 - DNA, 510 bp, Homo sapiens
  misc_feature: HEFZJCU01CRRWT.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattgagccatggcttatgctgggacaacagaatacgccgcgtctgtgaaaggcagattcatcatctcaagagatgattccaacggcatcgcctatcctgcagatgaacagcctgaagaccgagacacagccgtctattactgtagtaggtagttttacgtatttttggta

SEQ ID NO: 529035 - DNA, 509 bp, Homo sapiens
  misc_feature: HEFZJCU01BZH6A.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaaggccgattcaccatctccagagacaattccaggaacacaatgtatttggagctgaacagcctaagtcctgaggacacgggcgtatactactgtacgaaggagggggacgagcggagttccaagtactcgttgtacg

SEQ ID NO: 529036 - DNA, 508 bp, Homo sapiens
  misc_feature: HEFZJCU01CWEE5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacccttaacactggtgtcacagtgtcttcacccatcctccgggacagacttaccatgaccacgaactcctccataaacacagctacatggagttgaggagcctgacatctgacgacacggccgtctattactgtgcgagagtcccacgatccggtgagccctagggcagcggccctttggaccttcgtc

SEQ ID NO: 529037 - DNA, 519 bp, Homo sapiens
  misc_feature: HEFZJCU01D9XH5.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggccatcggtcttcccctggcgcctgctccaggagcacctccgagagcacagcggccctgggctgcctggtcaaggactactaccg

SEQ ID NO: 529038 - DNA, 513 bp, Homo sapiens
  misc_feature: HEFZJCU01DI9H6.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagccgtggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactacgtgggccaac

SEQ ID NO: 529039 - DNA, 533 bp, Homo sapiens
  misc_feature: HEFZJCU01BEL5J.7.78.H01.1.454.heavy.3.raw
cgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccgagggaaccctggtcaccgtctcctcagcctccaccaaggccc

SEQ ID NO: 529040 - DNA, 498 bp, Homo sapiens
  misc_feature: HEFZJCU01C806M.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatggcaggggccctcccgaccatccggttatttctttgactccgtggggccagggaacccgtggtcaccgtctcctc

SEQ ID NO: 529041 - DNA, 373 bp, Homo sapiens
  misc_feature: HEFZJCU01AXUR0.49.29.C07.1.454.heavy.3.raw
agtcgagagacacgaccggtgctcgatttagagtgctacgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctcccgagagcacagcggccctgggctgcctggtcaaggactacttcctctctcgact

SEQ ID NO: 529042 - DNA, 495 bp, Homo sapiens
  misc_feature: HEFZJCU01C2NVB.49.4.A04.1.454.heavy.3.raw
  modified_base (457)..(457): a, c, t, g, unknown or other
  modified_base (475)..(475): a, c, t, g, unknown or other
agtcgagagacacgaccggtgctcgatttagagtagtgatcagggggggagaggagcccagcactagaagtcggcggtgcttccattcggtgatcagcactgaacacagaggactcaccatggagtttgggctgagctgggtttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccagcaaggggctggagtgggtggcatttatctcatatgatggaagcaagatatactacattgactccgtgaagggccgattcatcatctccagagacactccgagaacacactgtatcttacaatgaacgaggttgagtagctgagacacggctttatnttactgtgcgaactttancacggaggtacaacggtccg

SEQ ID NO: 529043 - DNA, 496 bp, Homo sapiens
  misc_feature: HEFZJCU01EHLXX.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcttgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctagagagctgcggacaccggctgtgtattactgtgggagagagtggaggtcgatattgt

SEQ ID NO: 529044 - DNA, 403 bp, Homo sapiens
  misc_feature: HEFZJCU01EFHLH.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgcttggtcaaggactacttccgagtagtaca

SEQ ID NO: 529045 - DNA, 415 bp, Homo sapiens
  misc_feature: HEFZJCU01B3PR9.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggtcagggtcaccatgacctgggacgcgtccatcagcacagtctacatggat

SEQ ID NO: 529046 - DNA, 510 bp, Homo sapiens
  misc_feature: HEFZJCU01CXA9W.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacgacggggttgtttagttactggtgggaggaaactccgtaaggttgggctac

SEQ ID NO: 529047 - DNA, 464 bp, Homo sapiens
  misc_feature: HEFZJCU01D3GIC.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcccgaagaccgaggacacagccatttactattgtacaaatgaatactggggacgggggaaaattggggccagggaaccctggtctccgtctcgtcagcctccaccaagggcccatcggtcttcccctggcgccctgctccaggagcacctccgagacgcacagcggccctgggctgcctggtcaaggactacttcccacgagagta

SEQ ID NO: 529048 - DNA, 516 bp, Homo sapiens
  misc_feature: HEFZJCU01CGHRQ.51.12.B01.1.454.heavy.3.raw
cgatcgtatacacgaccggtgctcgatttagtagtgtagattccgcggggagcatcacccagcaaccacatctgtcctctagagaaccccctgagagccccgctcctcaccatgggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacaagaggttcgcttactggttcggaggcgtctcccccgtacg

SEQ ID NO: 529049 - DNA, 502 bp, Homo sapiens
  misc_feature: HEFZJCU01D9WBU.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttccccctggcgccctcgctccacggagcacctccgagagcacagcggccctgggctgcctggtcaggactacttcctagtacgtga

SEQ ID NO: 529050 - DNA, 504 bp, Homo sapiens
  misc_feature: HEFZJCU01DVZSW.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcgtcttcccctgcaccctcctccaagagcacctctgggggcacagcggccctgggctgcctggtcaaggactacttccgagtagtaca

SEQ ID NO: 529051 - DNA, 508 bp, Homo sapiens
  misc_feature: HEFZJCU01BOPWR.11.57.F02.1.454.heavy.3.raw
  modified_base (481)..(481): a, c, t, g, unknown or other
  modified_base (494)..(494): a, c, t, g, unknown or other
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcagtagtggtgcgaccatatactacgcagactctgtgaacgggccgatcatcatctccagagacatggcaacaactcactgtatctaggaaatnaacagcctagagngtacgaggacacgg

SEQ ID NO: 529052 - DNA, 518 bp, Homo sapiens
  misc_feature: HEFZJCU01CFDSA.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcgtccttcccctggcgccctgctccaggagcacctccgagagcaccagccggccgtcgggctcg

SEQ ID NO: 529053 - DNA, 477 bp, Homo sapiens; identical to SEQ ID NO: 444659
  misc_feature: HEFZJCU01CRCYK.16.10.A10.1.454.heavy.3.raw

SEQ ID NO: 529054 - DNA, 348 bp, Homo sapiens
  misc_feature: HEFZJCU01CRI99.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgtccaggctccagggaaggggctggagtgggtggccagcgtgaagca

SEQ ID NO: 529055 - DNA, 496 bp, Homo sapiens
  misc_feature: HEFZJCU01BW57A.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtggggtggggtgggtcagcgcttaccaagttggctacacaaattatgcacagaagttccaggacagagtcaccatcgaccacagacacatccacgagcacagcctacatggaactgaggagcctgagatctgacgacacggccgtatattttctgcgcgagagacgtaaagtagacgtggtattccgggggg

SEQ ID NO: 529056 - DNA, 539 bp, Homo sapiens
  misc_feature: HEFZJCU01AWH4Z.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgttgtttagttggggccaggggagcccgtggtccaccggt

SEQ ID NO: 529057 - DNA, 504 bp, Homo sapiens
  misc_feature: HEFZJCU01A7TFS.3.20.B09.1.454.heavy.3.raw
  modified_base (488)..(488): a, c, t, g, unknown or other
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacgacgtccaagagccagttctccctgaagctgagggctgtgagcgccgcagacacggccgtgtattactgtgcgagactggccgcaacagactacggtgcgaactcctatcgcttttgattanactggggccaagggac

SEQ ID NO: 529058 - DNA, 523 bp, Homo sapiens
  misc_feature: HEFZJCU01A9IGX.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtcttcccctggccgccctcgctccaggacggcacctccgagagcacagccggcctcgggctcg

SEQ ID NO: 529059 - DNA, 501 bp, Homo sapiens
  misc_feature: HEFZJCU01BJZ6Q.10.38.D05.1.454.heavy.3.raw
  modified_base (432)..(432): a, c, t, g, unknown or other
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcgtcttcccctggcncctgctccaggagcacctccgagacgcacagcggccctgggctgcctggtcaagactactccactacta

SEQ ID NO: 529060 - DNA, 498 bp, Homo sapiens
  misc_feature: HEFZJCU01DCGJH.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggaggggggtgggtg

SEQ ID NO: 529061 - DNA, 513 bp, Homo sapiens; identical to SEQ ID NO: 479030
  misc_feature: HEFZJCU01BIDVZ.15.67.G01.1.454.heavy.3.raw

SEQ ID NO: 529062 - DNA, 507 bp, Homo sapiens; identical to SEQ ID NO: 458256
  misc_feature: HEFZJCU01EVFDA.11.72.G06.1.454.heavy.3.raw

SEQ ID NO: 529063 - DNA, 485 bp, Homo sapiens
  misc_feature: HEFZJCU01AQ7DW.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagggcggt

SEQ ID NO: 529064 - DNA, 512 bp, Homo sapiens
  misc_feature: HEFZJCU01EXVB5.21.76.G10.1.454.heavy.3.raw
tcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatcccaacctggggggtccctgagactctcctgtgcggtctctgggttcaccgtcactactaactccatgagctgggtccgccaggctccagggaaggggctggagtgggtctcagttatttatagtggtggtggtgcagattacgcagactccgtgaagggccgattcaccatctccagagacaattccatgaacacgctgtatcttcaaatgaacagcctgagagccgacgacacggcccgtactattactgtgcgacgggagtgacggggaggagggcataggatactttgaccacgt

SEQ ID NO: 529065 - DNA, 350 bp, Homo sapiens
  misc_feature: HEFZJCU01EAE03.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggaggtctcgggcgtgagcgtggcgtttttctttgtggctatttttaaaaggttaggttccagttgtggaggtgcagctgtttgggagtcttgggggagggcttgggcaccagcctggggggtcccgtgagactctcctgtgcagtcctctggacttctacctttacgtacaagctatgccatgacctgggtcccgccagggcttccaggggaaggggcgtggaatgggtctc

SEQ ID NO: 529066 - DNA, 542 bp, Homo sapiens
  misc_feature: HEFZJCU01ED6RE.13.65.F10.1.454.heavy.3.raw
tcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgtagaagggtacggtttttgggggcgtcggactccgtcttgagatcgttcgggggccgagggggaaccgaagtcgggtcaccgtctctttcacgt

SEQ ID NO: 529067 - DNA, 508 bp, Homo sapiens
  misc_feature: HEFZJCU01A4YDD.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctcggaaccccgagtcgtacg

SEQ ID NO: 529068 - DNA, 540 bp, Homo sapiens
  misc_feature: HEFZJCU01DZCR8.2.85.H08.1.454.heavy.3.raw
acgctcgacacacgaccggtgctcgatttagtatcactcagtcgcggggccctgggagcacagctcatcaccacggactggacctggaggttcctctttgtggtggcagcagctacaggtgtccagtcccaggtccagctggtgcagtctggggctgaggtgaagaagcctgggtcctcggtgagggtctcctgcaaggcttctggaggcacctttcaggacctatattatgacctggggtgcgacaggcccctggacaagggcttgagtggctgggggggatcatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgattattgaatttcgactcctaccactaccggtattggacgttctcgggggtccaggggggaccaaccgggtcacccggttcttccgtttcacg

SEQ ID NO: 529069 - DNA, 504 bp, Homo sapiens
  misc_feature: HEFZJCU01AW7FU.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactccaccatctccagagacaacgccaagaactcactgtatctgcaaatgaacagcctgagagccgaggacacggctgtgtattactgtgcgagaggagctattatctacggaaccccgagt

SEQ ID NO: 529070 - DNA, 398 bp, Homo sapiens
  misc_feature: HEFZJCU01ERE0G.53.42.D09.1.454.heavy.3.raw
cgcgtatacacacgaccggtgctcgatttagacacatacgcagggaaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctgtgttctactgtgcaagaggcggcagtggctacagtgcctactactacggtctggacgtctgggccaggggaccactgtcaccgtctcctcagcctccacccaagggcccatcggtcttccccctggcaccctcctccaagagcacctctgggggcacagcggccctggctgcctggtcaaggactacttcctcgtactgcg

SEQ ID NO: 529071 - DNA, 433 bp, Homo sapiens
  misc_feature: HEFZJCU01A6HOH.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctagagaggcgaggacaaggccagggggtttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 529072 - DNA, 541 bp, Homo sapiens
  misc_feature: HEFZJCU01E092M.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattacaaaagcacgctgtatctgcaaatgaacagcctgagaaccgaggacacagccgtgtattactgtaccacactccctagaaacgcgtacaactactactactacggtatggacctcgtggggaccg

SEQ ID NO: 529073 - DNA, 502 bp, Homo sapiens
  misc_feature: HEFZJCU01BPRJ2.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacggattaccacggaccacccccacgaacacagtctacatgcaactgacgagcctgagagctgacgacacggccgtctattactgtgcgagaatgttttctgtcatcgtacaattgataggctctatggtactgacttctc

SEQ ID NO: 529074 - DNA, 493 bp, Homo sapiens
  misc_feature: HEFZJCU01BXMUL.47.55.E11.1.454.heavy.3.raw
agctcacgtacacgaccggtgctcgatttagcactcgcacgttggggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgagtgccttcggtccgcgggacttctggggccagggaaccctggtcagcgtctcctcagcctccaccaagggcccatcggtcttcccctggcgccctgctccaggagcacctccgagaggcacacgcggcccgtgggctggcctggtcaaggactacttcctacgtgagtct

SEQ ID NO: 529075 - DNA, 483 bp, Homo sapiens
  misc_feature: HEFZJCU01D3GLL.3.63.F08.1.454.heavy.3.raw
  modified_base (429)..(429): a, c, t, g, unknown or other
  modified_base (432)..(432): a, c, t, g, unknown or other
  modified_base (446)..(446): a, c, t, g, unknown or other
agacgcactccacgaccggtgctcgatttagcgatcgtataaggggctctgagagaggagcctttagccctggattccaaggcctatccacttggtgatcagcactgagcaccgaggattcaccatggaactgggctccgctgggttttccttgttgctattttagaaggtgtccagtgtgaggtgcagctggtggagtctgggggaggcctggtcaagcctgggggtccctgagactctcctgtgcagcctctggattcaccttcagtagctagtagctatgaactgggtccgccaggctccaggggaagggctggagtgggtctcatccagttagtagtagtagtagttacatatactacgcagacttcagtgaagggccgattccaccatcctccagacgtacaacgaccaaggaactcacctgtntcngacaaatgaacacnccgtgagagccggaggaccgacggtctgtgtatttac

SEQ ID NO: 529076 - DNA, 507 bp, Homo sapiens
  misc_feature: HEFZJCU01DEJCG.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggtttccttgttgctcttttaaaaggtgtccagtgtgaggtgcaggtagtggagtccgggggaggcttagttcagcctggggatccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggacttctggggccagggaacctc

SEQ ID NO: 529077 - DNA, 510 bp, Homo sapiens
  misc_feature: HEFZJCU01A8224.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggtcctttgacttctggggccaggggacg

SEQ ID NO: 529078 - DNA, 494 bp, Homo sapiens
  misc_feature: HEFZJCU01AEY3Y.14.58.F03.1.454.heavy.3.raw
  modified_base (481)..(481): a, c, t, g, unknown or other
cgtctagtaccacgaccggtgctcgatttagtctgatcgagaagggaaaggggctgggagaggagcccagcactagaagtcggcggtgtttccattcggtgatcagcactgaacacagaggactcactatggagtttgggctgagctgggttttcctcgctgctcttttaagaggtgtccagtgtgaggtgcagctggtggagtctggggggagcgtggtccagcctgggaggtccctgagactctcctgtgcagcctctggattcaccttcgataattatgacatagactgggtccgccaggctccaggcagggggctggagtgggtggcaataatatcatatgatgggagcaataaatattatgaagactctgtgaagggccgattcaccatctccagagacaattccaagaacacggtatatttggaaatgaacagcctgagaggtgacgacacggctgtgtattattgtgcgaaagngatgtggcgtctt

SEQ ID NO: 529079 - DNA, 532 bp, Homo sapiens
  misc_feature: HEFZJCU01D80QL.3.52.E08.1.454.heavy.3.raw
agacgcactccacgaccggtgctcgatttagtcgagctctcccgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtggggtctcagttatttacaattctggtaccacatactactccgaccccgtgaagggccgagttaaccatctccagagacgaattccgagaacacggtgtatcttcaaatgaacaacctgagagccgacgacacggccgtttattactgtgcgtagagattcgagtggttcggggacctcaccctggttctacttcgatctctggggccgtggcc

SEQ ID NO: 529080 - DNA, 506 bp, Homo sapiens
  misc_feature: HEFZJCU01BGSN6.11.57.F02.1.454.heavy.3.raw
  modified_base (493)..(493): a, c, t, g, unknown or other
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagngtcgaggacacgg

SEQ ID NO: 529081 - DNA, 523 bp, Homo sapiens
  misc_feature: HEFZJCU01A4F8P.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccggacgacaacggccgtctattattgtgtcatagacctaggactacaacgacggtcggtacctggtattcc

SEQ ID NO: 529082 - DNA, 507 bp, Homo sapiens
  misc_feature: HEFZJCU01DL2S0.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctctaattcgtggggccagggacg

SEQ ID NO: 529083 - DNA, 418 bp, Homo sapiens
  misc_feature: HEFZJCU01EBGVA.51.85.H08.1.454.heavy.3.raw
cgatcgtatacacgaccggtgctcgatttagtatcactcagtcgcgggggctctgggagaggagaccagcactagaagtcggcggtgtttccattcggtgatcagcactgaacacagaggtctcaccatggagtttgggctgcgctggattttcctcgttgctctttttagaggtgcccagtgtcagatacaactggtggagtcggggggaggcgtggtccagcctggggggtccctgagagtctcgtgtgcagcctctggattcaccttcaggcgttacggcatgaactgggtccgccaggctccagcctccaccaagggcccatcggtcttccccctggccaccctcctccaagagcacctctgggggcacagcggccctgggctgcctggtcaaggactacttcctcgtagcact

SEQ ID NO: 529084 - DNA, 537 bp, Homo sapiens
  misc_feature: HEFZJCU01CYHCD.16.87.H10.1.454.heavy.3.raw
  modified_base (453)..(453): a, c, t, g, unknown or other
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactggtccgccaagctccagggaaggggctggtgtgggtctcacatattaatctcgatgggagtaattagcctacgcggactccgtcaagggccgattcaccgtctccagagacaacaccaaagaacacactaatatctgcagattgacagtactgagacccgaggacacggntgtgtattactgtgcgaaggcagttcgtagaaacagttatgggttggggggtaggttgggttttttttcgtttacgttacgggt

SEQ ID NO: 529085 - DNA, 513 bp, Homo sapiens
  misc_feature: HEFZJCU01B0ZXF.52.37.D04.1.454.heavy.3.raw
  modified_base (491)..(491): a, c, t, g, unknown or other
cgcagtacgacacgaccggtgctcgatttagtagcatactgttgggtttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacgacggtctatttattactgtgtcgaggaggaagtgggatattgtgcagctccgagggtcncccgagcccggcccctttaccg

SEQ ID NO: 529086 - DNA, 554 bp, Homo sapiens
  misc_feature: HEFZJCU01CLDKC.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccaggggaagggcctggagtggatctcacttatttatagtggtggtaccacatactacacagactccgtgaacgggccgattccaccatctcagaagacaattccaggaacacattgtatcttcaaatgaataacctgagagcgaggacacggccatgtattactgtgtggggctatttacttcgtaccccgttgggggacccgggggtaacccgtcggtccaacccgtccgtcccccaacccctccccaacccg

SEQ ID NO: 529087 - DNA, 514 bp, Homo sapiens
  misc_feature: HEFZJCU01AM84Q.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtgcagttgttcatctgagggcagtgttcaatggtatgctgacgccgtgaaggccgattcaccatctccagagacaacctccaggaacacaatagtatttggacctgaacagctaagtcctagaggacacgggtgtatactactgtacgaagggagggggaaccagcgggagttccaagtactctttg

SEQ ID NO: 529088 - DNA, 507 bp, Homo sapiens; identical to SEQ ID NO: 474316
  misc_feature: HEFZJCU01EN32K.51.21.B10.1.454.heavy.3.raw

SEQ ID NO: 529089 - DNA, 514 bp, Homo sapiens
  misc_feature: HEFZJCU01A23YM.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacgccgtgtattactgtgcgagagagtggggcccacgaacgttactacgctatggacgtctggggaccg

SEQ ID NO: 529090 - DNA, 499 bp, Homo sapiens
  misc_feature: HEFZJCU01B6LUW.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttaagaaggtgtccagtgtgaggtgcagctggtggagtctgggggaggcctggtcaagcctggggggtccctgagactctcctgcgcagcctctggattcaccttcagtagttatagcatgaactggtccgccaggctccagggaagggctggagtgggtctcatccattagtagtaatagtgcctacagatactacgcagactcactgaaggccgactcaccatctccagagacaacgccaagaactcactgtatctgcaaatgaacagcctgagagccgaaggacacggctgtgtattactgtgcgagaggagctattatctggaaccccgat

SEQ ID NO: 529091 - DNA, 535 bp, Homo sapiens
  misc_feature: HEFZJCU01A8MMM.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgtccgtttatttttgtacgtagagcgtcgtctgtcagtggaattggactactggggccagggaaccctcggtcaccgtctcctcagcctccaccaacggg

SEQ ID NO: 529092 - DNA, 552 bp, Homo sapiens
  misc_feature: HEFZJCU01DJL4N.49.81.H04.1.454.heavy.3.raw
  modified_base (446)..(446): a, c, t, g, unknown or other
agtcgagagacacgaccggtgctcgatttagtagtgtagattcgcggggtctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtgggcagttatatcgaatgatggaagtaagaagtactatgcagactccgtgaagggccgattcaccatctccagagacaattccaagaacacgctatatttgcacatgaacagcctgagganctggaggacgaacgggtctattttattaccttggtggtccggaaactttaaatccaaccgggagggtaaccaaagggggttcgaccccccgttacccaccgttacc

SEQ ID NO: 529093 - DNA, 496 bp, Homo sapiens
  misc_feature: HEFZJCU01C7I8M.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctccccagcctccaccaagggcccatcggtcttcccctggcaccctcctccaagagcacctctgggggcacagcggccctgggctgcctggtcaaggactacttccgagtagtaca

SEQ ID NO: 529094 - DNA, 518 bp, Homo sapiens
  misc_feature: HEFZJCU01BMRW0.15.73.G07.1.454.heavy.3.raw
tctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgactcttgggccagggaaccctggtcaccgtctcctcagcctccaccaagggcccatcggtcttcccctggcaccctcctccaagagcacctctgggggcacagcggccctgggctgcctggttaaggactacttccgctaccgtagtacg

SEQ ID NO: 529095 - DNA, 506 bp, Homo sapiens; identical to SEQ ID NO: 446520
  misc_feature: HEFZJCU01DQTTV.10.38.D05.1.454.heavy.3.raw

SEQ ID NO: 529096 - DNA, 522 bp, Homo sapiens
  misc_feature: HEFZJCU01EM7K0.40.10.A10.1.454.heavy.3.raw
tctagcgactcacgaccggtgctcgatttagcgtcgatctcaggggtcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcacttgtttctgcaaatgagcagcctgagagccgaggacacggctctatattactgtacgagagatttcagccccctacccaaagtggaaaatttagttaatcgaatggactt

SEQ ID NO: 529097 - DNA, 520 bp, Homo sapiens
  misc_feature: HEFZJCU01C6S6P.9.70.G04.1.454.heavy.3.raw
  modified_base (509)..(509): a, c, t, g, unknown or other
tgatacgtctcacgaccggtgctcgatttagtgtagtgtgaagggaaagggcctgtgaaggcttcactagtcctggacctcctgtgcaagaatatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgttgcgagagaggccgttattttaggaccagctgttaaaactcctactacggtctggacgtctggggccnggggacctaac

SEQ ID NO: 529098 - DNA, 503 bp, Homo sapiens
  misc_feature: HEFZJCU01AURAW.51.64.F09.1.454.heavy.3.raw
cgatcgtatacacgaccggtgctcgatttagcgcgtatacaagggggggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtcttattactgtgcgaaacggaatgagtgggaacgtagggtttgagtaac

SEQ ID NO: 529099 - DNA, 516 bp, Homo sapiens
  misc_feature: HEFZJCU01EWOPL.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaagggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatagttcggggagtttaatataacgacgtatttcgtac

SEQ ID NO: 529100 - DNA, 506 bp, Homo sapiens
  misc_feature: HEFZJCU01AL3Z4.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaatgaacagcctgacagtcacgacacggccatgttatttttgtgtcgagcgacccggggctcctcaatggctttcattacg

SEQ ID NO: 529101 - DNA, 523 bp, Homo sapiens
  misc_feature: HEFZJCU01BS7D3.3.82.H05.1.454.heavy.3.raw
  modified_base (517)..(517): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaatgaacacctgagagccgacgacgacggccgtttattactgtgcgagagattcgagtggttcgggggacctccaccctggttctacttcgatcctntgggcc

SEQ ID NO: 529102 - DNA, 496 bp, Homo sapiens
  misc_feature: HEFZJCU01ACYXS.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttccccctggccgccctgctccaggagcacctccgacgagcacagcggccctggggctgccctggtcaaggactacttcccacgagagta

SEQ ID NO: 529103 - DNA, 509 bp, Homo sapiens
  misc_feature: HEFZJCU01C9I34.12.11.A11.1.454.heavy.3.raw
  modified_base (497)..(497): a, c, t, g, unknown or other
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgagacgtcctacggtgacaaatttnttacaaccagac

SEQ ID NO: 529104 - DNA, 519 bp, Homo sapiens
  misc_feature: HEFZJCU01B7963.7.78.H01.1.454.heavy.3.raw
  modified_base (457)..(457): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacganagcgtcgtctgtcagtggaattgactatggggccagggaaccctggtcaccgtctcctcacg

SEQ ID NO: 529105 - DNA, 492 bp, Homo sapiens
  misc_feature: HEFZJCU01DEJBW.51.6.A06.1.454.heavy.3.raw
cgatcgtatacacgaccggtgctcgatttagatctactgacagggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtggaagggccgattcaccatctccagacgacaatcccaagaacacactttatctgcaaatgaacaccctgacgacttgaggacacggctgtctattattgttgcgagagggagatcgatcacagcacg

SEQ ID NO: 529106 - DNA, 524 bp, Homo sapiens
  misc_feature: HEFZJCU01ASN7P.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccaggcctggggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactggtacgaaggaggggggaaccagcgggagttccaagtactctttgacgtcgtc

SEQ ID NO: 529107 - DNA, 522 bp, Homo sapiens
  misc_feature: HEFZJCU01DMOGF.10.30.C08.1.454.heavy.3.raw
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctctatctaacaaatgaacagtctgagacctgaggacacggccttatatttctgtgcaaaagatctggagctggccgtgaccacgtcgggccacgggaacctc

SEQ ID NO: 529108 - DNA, 502 bp, Homo sapiens
  misc_feature: HEFZJCU01BRLZV.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagccaggtcaccgtcctccccagcctccaccaagggcccatcggtcttcccctcggcgcctgctccagagcacctccgacgagcacagcggccgtgggctgcctggtcaggactacttccactact

SEQ ID NO: 529109 - DNA, 499 bp, Homo sapiens
  misc_feature: HEFZJCU01DR4K3.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaagatttctatagaggtgacgtacgggggcgttacg

SEQ ID NO: 529110 - DNA, 485 bp, Homo sapiens
  misc_feature: HEFZJCU01DQTS8.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagacacacgcctacatgggacctgacgcggccgtgacatctgacgacacggccgtatatttctgtgcggaggg

SEQ ID NO: 529111 - DNA, 534 bp, Homo sapiens
  misc_feature: HEFZJCU01C2G67.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcacccctgacccacagacacatccgcgaacacagcctacatggaactgaggaatctgacatctgacgacacggccatatattactgtgcgagaaggacggtttttgggggcgcgggctcctcttgagatctggggcctagggggacaagtgggtccaccggtccttcttcctag

SEQ ID NO: 529112 - DNA, 528 bp, Homo sapiens
  misc_feature: HEFZJCU01BU4QY.14.57.F02.1.454.heavy.3.raw
  modified_base (474)..(474): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagctcncaaggccatcgtctccctggcaccctcctccagagcacctctggggcacgagcc

SEQ ID NO: 529113 - DNA, 493 bp, Homo sapiens
  misc_feature: HEFZJCU01CS58G.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgcctgctccagagcacctcgtgggggcacagcggccctgggctcgccgtcggtcaaggactacttccctacagtgct

SEQ ID NO: 529114 - DNA, 512 bp, Homo sapiens
  misc_feature: HEFZJCU01DDI45.51.5.A05.1.454.heavy.3.raw
  modified_base (444)..(444): a, c, t, g, unknown or other
cgatcgtatacacgaccggtgctcgatttagatagatagacaggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtctgcncctcgtgtggccccaatttggtttaccggcacacaaaatcagggcaagtcctacgacggtctggtacg

SEQ ID NO: 529115 - DNA, 512 bp, Homo sapiens
  misc_feature: HEFZJCU01EM7PU.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctcaccaaggccatcggtctcccctggcaccctcctccaagagcacctctgggggcacagcggccctgggctgcctggtcaggactcttccagacgtatca

SEQ ID NO: 529116 - DNA, 387 bp, Homo sapiens
  misc_feature: HEFZJCU01BSRU9.18.60.F05.1.454.heavy.3.raw
tacgagtatgcacgaccggtgctcgatttagtacgtcatcagggaaaggggctgggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcaccctcctccaagagcacctctgggggcacagcggccctgggctgcctggtcaaggactacttcccatactcgta

SEQ ID NO: 529117 - DNA, 561 bp, Homo sapiens
  misc_feature: HEFZJCU01EH8QU.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggtccacgggggacccctggtcattcgtctccccctagcccttacccacccaaggggccccaagtccggttccgtttcccccccttgggccccggccccgttcg

SEQ ID NO: 529118 - DNA, 506 bp, Homo sapiens
  misc_feature: HEFZJCU01EA0IL.40.81.H04.1.454.heavy.3.raw
tctagcgactcacgaccggtgctcgatttagtagtgtagattcgcggggacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatagtattactgtggaagagacgttggtggctaccggcggggctgaccactggggccagggaacctggt

SEQ ID NO: 529119 - DNA, 526 bp, Homo sapiens; identical to SEQ ID NO: 468516
  misc_feature: HEFZJCU01ETEZK.7.78.H01.1.454.heavy.3.raw

SEQ ID NO: 529120 - DNA, 395 bp, Homo sapiens
  misc_feature: HEFZJCU01DWTSO.12.24.C02.1.454.heavy.3.raw
atacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctctttttgatatctggggccaaggggacaatggtcatcgtctcttcagcctccaccaagggcccatcggtcttccccctggccgccctgctccaggagcacctccgagagcacagccggccctgggctgcctggtcaaggactacttcctacgtcgtat

SEQ ID NO: 529121 - DNA, 492 bp, Homo sapiens
  misc_feature: HEFZJCU01A9LBD.48.39.D06.1.454.heavy.3.raw
agtatacatacacgaccggtgctcgatttagtgacatctcggcagttctttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccaggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggcgagggac

SEQ ID NO: 529122 - DNA, 523 bp, Homo sapiens
  misc_feature: HEFZJCU01CTTL6.19.67.G01.1.454.heavy.3.raw
  modified_base (484)..(484): a, c, t, g, unknown or other
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcgaggtatttttataggtgggacgacattctacgggagactccatgggagggccgattcaccatctccagagactttttctcagaacacactgtctcttcaaatgaacagcctgagggccgaggacacggccgtctattattgtgtgagagtttanggtcgatcggctgggtggacaggactcactggggccaac

SEQ ID NO: 529123 - DNA, 512 bp, Homo sapiens; identical to SEQ ID NO: 447721
  misc_feature: HEFZJCU01EGT3G.17.33.C11.1.454.heavy.3.raw

SEQ ID NO: 529124 - DNA, 531 bp, Homo sapiens
  misc_feature: HEFZJCU01DG9VU.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttctttcaaatggacagcctgaaagacgaagacacgggcgtgtatttttgtgtgaaagatacgaagtctatgatacccaatttgggaggggccgtttcatgtctggggccgaagggacgctggtcaccgtctcttcagctccaccaaggccatcggtcttcccctggcaccctcctccaagagcacctctggggc

SEQ ID NO: 529125 - DNA, 510 bp, Homo sapiens
  misc_feature: HEFZJCU01DWYWN.10.38.D05.1.454.heavy.3.raw
  modified_base (470)..(470): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtntcgcgacatgactacgctcaattcgtgggtccgagggacg

SEQ ID NO: 529126 - DNA, 505 bp, Homo sapiens; identical to SEQ ID NO: 472729
  misc_feature: HEFZJCU01D1GNY.10.38.D05.1.454.heavy.3.raw

SEQ ID NO: 529127 - DNA, 520 bp, Homo sapiens
  misc_feature: HEFZJCU01EVNHS.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaaaggcggcggacgaggaggttcgtcttactggttcggaggctcctccccctacgg

SEQ ID NO: 529128 - DNA, 547 bp, Homo sapiens
  misc_feature: HEFZJCU01BYEFK.17.28.C06.1.454.heavy.3.raw
  modified_base (532)..(532): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatggtaggaaaaagtaagtggctgtgtttagttgggggaccagggggacncccgtgggtccaacg

SEQ ID NO: 529129 - DNA, 518 bp, Homo sapiens
  misc_feature: HEFZJCU01CS98S.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgtataaattatgcggactccgtgaggggccgattcagcatctccagagacaacggcaagagtatactgtatctggaaatgaacaatctgagagtcacgatacgggctgtctatcattgtgttttcgatgccttcggtcccgacgggtacttctgggggtcccagggtaaccccg

SEQ ID NO: 529130 - DNA, 508 bp, Homo sapiens
  misc_feature: HEFZJCU01BOZST.10.38.D05.1.454.heavy.3.raw
  modified_base (493)..(493): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgaacgacaccggccacctattattgtgcgcgacatgactacgctcattcnggggtccaggggacg

SEQ ID NO: 529131 - DNA, 515 bp, Homo sapiens
  misc_feature: HEFZJCU01CX6Y2.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatgggttcggggagttattagtccctactttgactacgtggggccagggactctggtcaccgtctccgcagcctcccaccaacggcccc

SEQ ID NO: 529132 - DNA, 519 bp, Homo sapiens
  misc_feature: HEFZJCU01CLBFM.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgtactccggttgaagccctaacgggccaggccgggtccctttggacctttctc

SEQ ID NO: 529133 - DNA, 500 bp, Homo sapiens
  misc_feature: HEFZJCU01DW9SD.53.1.A01.1.454.heavy.3.raw
cgcgtatacacacgaccggtgctcgatttagacgtctcatcagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggaccaagggcttgagtggatgggaaggatcatcccaatccttggtattacaaaaatgcacagaggtttcagggcagagtcctgttaaccgcggacaaatccactaccacagtctacatggagctgagcagcctgagatctgaagacacggcctgtactattgtgcgagagaaatgtacttctatgacagtactaatacaatatgtcttttgat

SEQ ID NO: 529134 - DNA, 507 bp, Homo sapiens
  misc_feature: HEFZJCU01EJFYU.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaagggctggagtgggtttcatatattgatagaaatagtggaaccatatactatgcagactctgtgaggggccgattcaccatctccagagacaatgccaggaattcactgtatgtggaaatgaacagtctgagagccggaggacacggctctctattactgtgcgagacgaccccgaaaatagggtctaacg

SEQ ID NO: 529135 - DNA, 374 bp, Homo sapiens; identical to SEQ ID NO: 444640
  misc_feature: HEFZJCU01AY8HO.7.37.D04.1.454.heavy.3.raw

SEQ ID NO: 529136 - DNA, 500 bp, Homo sapiens
  misc_feature: HEFZJCU01BFFVT.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagcggaggacacggctgtgtattactgtgcgagaggagctattatctggaaccccgat

SEQ ID NO: 529137 - DNA, 475 bp, Homo sapiens
  misc_feature: HEFZJCU01EU6EH.16.10.A10.1.454.heavy.3.raw
  modified_base (154)..(154): a, c, t, g, unknown or other
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagnggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaaggcccatcggtcttccccctgcaccctcctccaagagcacctctggggcacagcggccctgggctgcctggtcaaggacttacttccgagtagtaca

SEQ ID NO: 529138 - DNA, 503 bp, Homo sapiens
  misc_feature: HEFZJCU01DTKVM.11.71.G05.1.454.heavy.3.raw
cgagagataccacgaccggtgctcgatttagtgtcgtcgcaagagagaggggggggagaggagcccagcactagaagtcggcggtgtttccattcggtaagatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagtatttctatagtaggtgacgtac

SEQ ID NO: 529139 - DNA, 501 bp, Homo sapiens
  misc_feature: HEFZJCU01BPM7N.40.81.H04.1.454.heavy.3.raw
  modified_base (473)..(473): a, c, t, g, unknown or other
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcgacaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggngtaccgcggggctgaccacgtggggccg

SEQ ID NO: 529140 - DNA, 517 bp, Homo sapiens
  misc_feature: HEFZJCU01CLC4B.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcgggacttcgtggggtccaggggtaacccg

SEQ ID NO: 529141 - DNA, 519 bp, Homo sapiens
  misc_feature: HEFZJCU01BKD9X.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggccccatcaccagttttaattattggtggggctggatccgccagcccccagggaaggggctggaatggattgggagtatatttttataattgggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatattggggccaagggacaagggtcaccgtctccgtcacgtcct

SEQ ID NO: 529142 - DNA, 511 bp, Homo sapiens
  misc_feature: HEFZJCU01D14C7.22.11.A11.1.454.heavy.3.raw
  modified_base (289)..(289): a, c, t, g, unknown or other
acatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccnccaggctccagggaaggggctgggagtggatctcagttatttatctcggtggtaacacatactacgcagactccgtggagggccgattcaccatctccagagacaattccaagaacacggtgtatctcaatgaacagcctgagagccgatagacgacggccgtgtattactgtgtgagatcaaattcaacgcgcgggggtccacccgaaattagactacgtc

SEQ ID NO: 529143 - DNA, 526 bp, Homo sapiens
  misc_feature: HEFZJCU01A94K3.49.19.B08.1.454.heavy.3.raw
  modified_base (418)..(418): a, c, t, g, unknown or other
agtcgagagacacgaccggtgctcgatttagtgagtcagtaagggggctctgagagaggagcccagccctgggattttcaggtgttttcatgtggtgatcaggactgaacagagagaactcaccatggagtctgggctgacgtggcttttgcttgtggctatcttaaaaggtgtccagtgtgacgtgcagttggtggagtcggggggaggcttggtacagccgggggggtccctgagactctcctgtacagtctctggcttcacctttagagtctatgacatgagttgggtccgccaggctccggggaaggggctggagtgggtctcaacgatcagtgatagtgaactaagacaaactatgccgactccgtgaagggccgatgcaccatctccagagacaactcgaaggacactttanatctgcaactcaacagactgacaaccgcggacgcggccgtctattactgtgtgaaagaagacgggaccgcgtggacgaggagcccgagaggaaaatcactaactttcg

SEQ ID NO: 529144 - DNA, 515 bp, Homo sapiens
  misc_feature: HEFZJCU01B4YLO.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatcctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccagggcccatcggtcttcccctggcgcctgctcaggagcacctcgtggggcacgacgccggcccg

SEQ ID NO: 529145 - DNA, 515 bp, Homo sapiens
  misc_feature: HEFZJCU01B2AI9.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgacgagcacagcggcctgggctcg

SEQ ID NO: 529146 - DNA, 489 bp, Homo sapiens
  misc_feature: HEFZJCU01B9KWH.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtcgcccttgatttacta

SEQ ID NO: 529147 - DNA, 540 bp, Homo sapiens
  misc_feature: HEFZJCU01BBSLI.13.65.F10.1.454.heavy.3.raw
  modified_base (448)..(448): a, c, t, g, unknown or other
tcacgtactacacgaccggtgctcgatttagctacgctctaaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacacgcctacatggaactgaggaatctgacatctgacgacacggccatatattactgtncgagaggacggttttggggcgcggactcctcttgagatcgtggggtcccgagggggaccaagttgggtccaccggtcttctttcacgtcccg

SEQ ID NO: 529148 - DNA, 449 bp, Homo sapiens
  misc_feature: HEFZJCU01DBHHK.53.28.C06.1.454.heavy.3.raw
cgcgtatacacacgaccggtgctcgatttagagctcacgtattgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 529149 - DNA, 505 bp, Homo sapiens
  misc_feature: HEFZJCU01AU9R6.12.55.E11.1.454.heavy.3.raw
  modified_base (472)..(472): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgctggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttccccnggcgccctgctccaggagcacctcgtggggcac

SEQ ID NO: 529150 - DNA, 508 bp, Homo sapiens
  misc_feature: HEFZJCU01CIN9M.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtgggattgggagtatctattatagttgggagtacctactacaacccgtccctcaagagtcgactcaccatatccgtagacacgtccaagaaccagttctccctgaagctgagctctgtgaccgccgcagacacggctgtgtattactgtgcgagggggccggagtattgttatagaaccacctgctatctgagctggttcgactgctggggccaggggaaccctgg

SEQ ID NO: 529151 - DNA, 374 bp, Homo sapiens; identical to SEQ ID NO: 444502
  misc_feature: HEFZJCU01ECLEE.9.14.B03.1.454.heavy.3.raw

SEQ ID NO: 529152 - DNA, 515 bp, Homo sapiens
  misc_feature: HEFZJCU01E1T9J.40.38.D05.1.454.heavy.3.raw
  modified_base (471)..(471): a, c, t, g, unknown or other
tctagcgactcacgaccggtgctcgatttagtatctgatagttggggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggactcgacagccgaggacacggaccaanattactgtgtgaggaagcagaaggtaggaggtcgtggtaggcgt

SEQ ID NO: 529153 - DNA, 486 bp, Homo sapiens
  misc_feature: HEFZJCU01EI5F2.40.83.H06.1.454.heavy.3.raw
tctagcgactcacgaccggtgctcgatttagatcacgtgcgtcgcgggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctggaggggccgattcatcatctctagagacaattcgaagaacacggcttatctgacaaatgaacagcctgacagtacgaggacacggctgtatattctgtgacgaatggaggtac

SEQ ID NO: 529154 - DNA, 481 bp, Homo sapiens; identical to SEQ ID NO: 461480
  misc_feature: HEFZJCU01B17RZ.7.10.A10.1.454.heavy.3.raw

SEQ ID NO: 529155 - DNA, 522 bp, Homo sapiens; identical to SEQ ID NO: 448016
  misc_feature: HEFZJCU01D5DX4.12.40.D07.1.454.heavy.3.raw

SEQ ID NO: 529156 - DNA, 508 bp, Homo sapiens
  misc_feature: HEFZJCU01EP6NF.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccgagggacgg

SEQ ID NO: 529157 - DNA, 507 bp, Homo sapiens; identical to SEQ ID NO: 462006
  misc_feature: HEFZJCU01DIAVC.10.88.H11.1.454.heavy.3.raw

SEQ ID NO: 529158 - DNA, 527 bp, Homo sapiens
  misc_feature: HEFZJCU01DLBA6.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtgggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 529159 - DNA, 517 bp, Homo sapiens
  misc_feature: HEFZJCU01DS3E0.49.81.H04.1.454.heavy.3.raw
agtcgagagacacgaccggtgctcgatttagtagtgtagattcgcgggggctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgacgaacttaatcacggaggacaaggggtcgacccccgtacaccg

SEQ ID NO: 529160 - DNA, 508 bp, Homo sapiens
  misc_feature: HEFZJCU01BVE5Z.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctcgtgggggcacgagcggccctgggctgcctggtcaaggactacttccgagtagtaca

SEQ ID NO: 529161 - DNA, 525 bp, Homo sapiens
  misc_feature: HEFZJCU01AL3W4.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaacgggcccatcggtcttcccctcggcaccctcctccaagagcacctctgggggcacgacgcggcccgtgggctgcctggtcaacggactacttcctagagacacg

SEQ ID NO: 529162 - DNA, 544 bp, Homo sapiens
  misc_feature: HEFZJCU01AYDRC.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccattctccagagaccattccaagaaccacccctatatcttcaaatgaacaacctgagagtcgaagacacggccgtatattactgtgcgagaccatgacttcggtcgacccccgttgggggcccaggggaaccccttcgggtccaacccggttctccctcgacgta

SEQ ID NO: 529163 - DNA, 521 bp, Homo sapiens
  misc_feature: HEFZJCU01BTCMZ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagagtggggcccacgaacgttactacgctagtggacgtcgtggggccaagggaccg

SEQ ID NO: 529164 - DNA, 505 bp, Homo sapiens
  misc_feature: HEFZJCU01DALMF.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagttttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattcaggaacacgctgtatcttcaaatgaacagcctgagagtcgaggacacggctgtatattactgtagcgagagatgtggtacgtcttttagatatcgt

SEQ ID NO: 529165 - DNA, 503 bp, Homo sapiens
  misc_feature: HEFZJCU01EO44Y.11.57.F02.1.454.heavy.3.raw
cgagagataccacgaccggtgctcgatttagctcgatatagttgggtttgggggctctcagataggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctggggggaggcttagtccaggccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggacaacaactcactgtatctaggaatcaacagcctgagagtcgaggacacggctgtatattattagtgcgagacgccccgtacggtgtac

SEQ ID NO: 529166 - DNA, 503 bp, Homo sapiens
  misc_feature: HEFZJCU01A268I.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatcggacgtc

SEQ ID NO: 529167 - DNA, 516 bp, Homo sapiens
  misc_feature: HEFZJCU01D7HBF.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacggccgtgtattactgtgtgagagacatgacaacggtgataaccgggaggggttag

SEQ ID NO: 529168 - DNA, 521 bp, Homo sapiens
  misc_feature: HEFZJCU01EEPEX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccattcaccatctccagagacaattccaagaacacgctgtttcttcaaatgaacagcctgagagccgatgacacggccgtgtattactgtgcgagagagtggggcccacgaacgttactacgctatggacgtcgtggggccgaagggaccg

SEQ ID NO: 529169 - DNA, 481 bp, Homo sapiens
  misc_feature: HEFZJCU01B1YHD.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccacgcgtatcgt

SEQ ID NO: 529170 - DNA, 507 bp, Homo sapiens
  misc_feature: HEFZJCU01BHN8V.11.57.F02.1.454.heavy.3.raw
  modified_base (374)..(374): a, c, t, g, unknown or other
cgagagataccacgaccggtgctcgatttagctcgatatagttgggtttggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagacnctgtgaagggccgattcatcatctccagagacaatggcacaactcaactgtatctggaaatcaacagcctgagagtcgaggacacggctgtatattagtttgtagcggagacggccccctacgggttcgaccg

SEQ ID NO: 529171 - DNA, 521 bp, Homo sapiens
  misc_feature: HEFZJCU01DUSLT.10.9.A09.1.454.heavy.3.raw
catagtagtgcacgaccggtgctcgatttagcgagacgcgcaggggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggactgaacagcctaagtcctgaggacacgggtgtatactactgtacgaggaaggggggaaccaggcgggagttacagtactcctttgacgtcgtgggaccg

SEQ ID NO: 529172 - DNA, 519 bp, Homo sapiens; identical to SEQ ID NO: 474023
  misc_feature: HEFZJCU01CJ8SO.2.81.H04.1.454.heavy.3.raw

SEQ ID NO: 529173 - DNA, 470 bp, Homo sapiens
  misc_feature: HEFZJCU01A2NIT.48.1.A01.1.454.heavy.3.raw
agtatacatacacgaccggtgctcgatttagacgtctcatcaaggaaggggggtccctgagactctcctgtgcaacctctggattcacattcactagatataccatgaactgggtccgccaggctccagcgaaggggctggagtgggtctcctccataagtagtggcagttcttacttacattacgcagactcagtgaaggccgattcgccatctccagagacaacgccaacaactcactgtttctgcagatggacaacctgagaggcgaggacacggctgtatattactgtgtctccccatacatcgcagctcgtggcacggactactggggccagggaacccctagtcaccgtctcctcagcctccaccaagggcccatcggtcttcccctggcgccctgctccaggagcacctccgagagcacagcggccctggctgcctggtcaaggactacttcctatgtatact

SEQ ID NO: 529174 - DNA, 523 bp, Homo sapiens
  misc_feature: HEFZJCU01CYR12.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattggggatgagagtaagcactacagtccgtctctgaagaacagctcaccatcaccaaggacacctccacaaaccaggtggtccttacaatgaccaatatgaccctgtggacacagccacatattactgttcacgctctatggttcggggagtttattagtccctactttgactacgtggggccagggtacctctggtcaccgtcctccgcagcctccaccaacggggcccagtcc

SEQ ID NO: 529175 - DNA, 529 bp, Homo sapiens
  misc_feature: HEFZJCU01CWYUZ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggtccaggggaccctgggtcatcgtctccccacgcctccaccaagggcccatcgggtcttcccccgtggccg

SEQ ID NO: 529176 - DNA, 513 bp, Homo sapiens
  misc_feature: HEFZJCU01CRVZ9.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctagagagccgacgacacggccatatattactgtgcgaaagcgaccgctagttagtcacccatactactttgactacgtggggccg

SEQ ID NO: 529177 - DNA, 500 bp, Homo sapiens
  misc_feature: HEFZJCU01EFFJR.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtggggtgtgggctggatccgtcagcccccaggaaaggccctggagtggcttgcactcatttattgggatgatgataagcgctacagcccatctctgatgaacaggctcaccatcaccaaggacgcctccaaaaccaggtggtccttacaatgaccaacatggaccctgtggacacagccacatattactgtgcacagagatacgggcgagcacggtggtttagggggctacgtggggccagggaacctggtcaccgtctcctcagcctccaccg

SEQ ID NO: 529178 - DNA, 529 bp, Homo sapiens
  misc_feature: HEFZJCU01B4M0O.17.33.C11.1.454.heavy.3.raw
  modified_base (461)..(461): a, c, t, g, unknown or other
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatcggtnttccccctggcaccctcctccaagagcacctctggggggcacgagcggcccgtgggctgcctggtacg

SEQ ID NO: 529179 - DNA, 501 bp, Homo sapiens
  misc_feature: HEFZJCU01B6FRC.51.71.G05.1.454.heavy.3.raw
  modified_base (372)..(372): a, c, t, g, unknown or other
cgatcgtatacacgaccggtgctcgatttagtgtcgtcgcaagagagaggggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagngtccgtgaagggccgattgaccatctccagagacaactcgaagaatacggttcttctacaaatgaacagcctgagagctgaggacacggctatgttttactgtgcgagagggaactcgattacagcacg

SEQ ID NO: 529180 - DNA, 454 bp, Homo sapiens
  misc_feature: HEFZJCU01B02XF.8.10.A10.1.454.heavy.3.raw
ctcgcgtgtccacgaccggtgctcgatttagcgtcgatctcaggggtccgggagatcatgagggtgtccttgggttttggggggaagaggaagactgacggtccccccaggagttcaggtgcccactcccaggttcagctggtgcagtctggagctgagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttggactactggggccagggatccctggtcaccgtctcctcagcctccaccaacgggcccatcggtcttccccctggcaccctcctccaagagcacctctgggggcacagtggccctgggctgcctggtcaaggactacttccgacacgcgag

SEQ ID NO: 529181 - DNA, 504 bp, Homo sapiens
  misc_feature: HEFZJCU01CXF23.10.35.D02.1.454.heavy.3.raw
catagtagtgcacgaccggtgctcgatttagcacacgatagttgggtttgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccggtctcctcagcctccaccaagggcccatcggtcttcccctggcgccctgctccaggagcacctccgagagcacagcggccctgggctgcctggtcaaggactacttcccactactatg

SEQ ID NO: 529182 - DNA, 507 bp, Homo sapiens
  misc_feature: HEFZJCU01E1STV.17.10.A10.1.454.heavy.3.raw
cgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgtttctgtcatcgtacaatttgataggctctatggactggacttctggggccaggggaccgacggtgatcgtctcatcagcctccaccaagggcccatcggtcttccccctcggccaccctcctccaagagcacctc

SEQ ID NO: 529183 - DNA, 516 bp, Homo sapiens
  misc_feature: HEFZJCU01AE4MW.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccgagggcagagtcaccattaccagggacacatccgcgaacacagcctacatggagctgacgggcctgacatctgaacgacacggcttttatatttaactgtgcgcgtagattggctggcacgagaggggcacgaactggacttccgacccc

SEQ ID NO: 529184 - DNA, 519 bp, Homo sapiens; identical to SEQ ID NO: 452709
  misc_feature: HEFZJCU01BHYYR.3.82.H05.1.454.heavy.3.raw

SEQ ID NO: 529185 - DNA, 401 bp, Homo sapiens; identical to SEQ ID NO: 454724
  misc_feature: HEFZJCU01DDQ90.47.24.C02.1.454.heavy.3.raw

SEQ ID NO: 529186 - DNA, 511 bp, Homo sapiens; identical to SEQ ID NO: 446675
  misc_feature: HEFZJCU01DBU17.4.23.C01.1.454.heavy.3.raw

SEQ ID NO: 529187 - DNA, 495 bp, Homo sapiens
  misc_feature: HEFZJCU01CT6KM.4.37.D04.1.454.heavy.3.raw
  modified_base (421)..(421): a, c, t, g, unknown or other
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgaagaagcctggggcctcagtgaaggtctcctgcaaggcttctggatacaccttcaccgcctactatatgcactgggtgcgactggcccctggacaagggcttgagtggatggggatggatcgaccctaacagcggtggcacaaagtatgcacagagttcagggcagggtcaccatgaccagggacacgtccatcagcacgtccatcagcacagccctanatggaccctaggagccggcctggaccagtctgacgtacgaccgccgtattatttcgtagtggtcgacgggagta

SEQ ID NO: 529188 - DNA, 517 bp, Homo sapiens
  misc_feature: HEFZJCU01BQIFK.48.27.C05.1.454.heavy.3.raw
agtatacatacacgaccggtgctcgatttagacgcgatcgaagggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgccggggcttcaaaggacggtttgacttctccttggccacctctgtcagcacggcatatctgcagatcagcagcctaaagcctgaggacactgccgtgtttttattgtgcgagagtcccaggcgagggaggataccgatttcttatatagcgactactactacttcggaatggg

SEQ ID NO: 529189 - DNA, 540 bp, Homo sapiens
  misc_feature: HEFZJCU01DBPHH.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggacgtacggttgactacgtgggggttacgaccccgtcggggccacgggaaccctcggctaccgtcctcctacacgccctccaacccg

SEQ ID NO: 529190 - DNA, 500 bp, Homo sapiens
  misc_feature: HEFZJCU01BDS9J.48.59.F04.1.454.heavy.3.raw
  modified_base (495)..(495): a, c, t, g, unknown or other
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcacgacacggctgtctattactgtgcgaggcccgagcgcagtggcttttgatgccttgatatgtgggccaaggacaatggtnaccgt

SEQ ID NO: 529191 - DNA, 509 bp, Homo sapiens
  misc_feature: HEFZJCU01D1I45.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacccctaacactggtgtcacagtgtcttcacccatcctccgggacagacttaccatgaccacgaactcctccataaacacagcctacatggagttgagggagcctgaccatctgacgacacggccgtctattactgtgcgagagtcccacgatccggtgagccacggcaggcggccttttgaccttcgtc

SEQ ID NO: 529192 - DNA, 515 bp, Homo sapiens
  misc_feature: HEFZJCU01D152I.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaagggctggagtgggtggccaacatagagtacgatggaagtgagaaaactatgtggactccgtgaagggccgattcaccatctccagagacaacgacaagaattagtgtatctgcaaatgagcagcctgagagccgaggacacggctggtgtattattgtg

SEQ ID NO: 529193 - DNA, 522 bp, Homo sapiens
  misc_feature: HEFZJCU01A2FNR.13.21.B10.1.454.heavy.3.raw
tcacgtactacacgaccggtgctcgatttagtgtcgtcgcaaagagagaggagccttagccctggacttccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggaccacggctattgtattactgtgcgagagatgagagtggctacagttgggggccgggggaaccctggtaccaccgtcaaa

SEQ ID NO: 529194 - DNA, 523 bp, Homo sapiens
  misc_feature: HEFZJCU01A0GSP.14.66.F11.1.454.heavy.3.raw
cgtctagtaccacgaccggtgctcgatttagtcacgcgagaagggtgccagggggaagaccgatgggcccaggactggtgaagccttcggagaccctgtccctcacctgcactgtctctggcggctccatcaatacttacaactggacctggatccggcagcccccagggaagggtctgaattggattgggtatatctctaacagtgggaggaccaactacaacccctccctccagagtcgagtcaccatttcattagacacgtccaagaaccagttctccctgaggttgaactctgtgaccgctgcggacacggccgtgtattattgtgcgagggtcggtggccacaatggcgagtacaactggttcgacccctggggccagggaaccctggtcaccggtctcctcagcctcaccaagggcccatcggtcttccccctcggcaccctcctccaagacgcacctctgggggcacagccggcctcgggctcgcctgggtcaaggactacttccgtactacgacg

SEQ ID NO: 529195 - DNA, 532 bp, Homo sapiens
  misc_feature: HEFZJCU01A1NS0.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcacttactttgactactggggccagggaaccctggtcaccgtcc

SEQ ID NO: 529196 - DNA, 506 bp, Homo sapiens
  misc_feature: HEFZJCU01AKW9O.17.25.C03.1.454.heavy.3.raw
  modified_base (477)..(477): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagacgtccggtgngcctacggcagcggcctttgactttcgtc

SEQ ID NO: 529197 - DNA, 538 bp, Homo sapiens
  misc_feature: HEFZJCU01D0X3F.48.14.B03.1.454.heavy.3.raw
agtatacatacacgaccggtgctcgatttagtgtgagtagttccgcgggggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgagagaatcctggggaccggccgtcgttcgggggccagggaacactggttatcgtctcttcacg

SEQ ID NO: 529198 - DNA, 516 bp, Homo sapiens
  misc_feature: HEFZJCU01BSYLT.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatctcaaatgaacaacctgagagtcgaagacacggccgtatattactgtgcgagacatgacttcggtgaccctggggccagggaaccctggtcaccgtctcctca

SEQ ID NO: 529199 - DNA, 496 bp, Homo sapiens
  misc_feature: HEFZJCU01BJEMG.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagactttaccatgaccacgaactcctccataaacacagcctacatggagttgaggagcctgacatctgacgacacggccgtctattactgtgcgagagtcccagactccggtgagccctacggcagcggcctttgacttc

SEQ ID NO: 529200 - DNA, 517 bp, Homo sapiens
  misc_feature: HEFZJCU01CZUYY.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgaggagtcccacgactaccgggtgacgcctacggcaggcggtcctttgacttcgtggggccaggggacg

SEQ ID NO: 529201 - DNA, 509 bp, Homo sapiens
  misc_feature: HEFZJCU01D5DQZ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggacaacgacctgagtggatgggatgggcgaaccctaacactggtgtcacagtgtcttcacccatcctccgggacagacttaccatgaccacgaactcctcataaacacagcctacatggagttgaggagcctgacatctgacgacacggccgtctattactgtgcgagacgtcccacgatccggtgacgccgtacggcagccggccttttagccttctc

SEQ ID NO: 529202 - DNA, 487 bp, Homo sapiens; identical to SEQ ID NO: 454270
  misc_feature: HEFZJCU01DS3DF.3.48.E04.1.454.heavy.3.raw

SEQ ID NO: 529203 - DNA, 526 bp, Homo sapiens
  misc_feature: HEFZJCU01C0NJS.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggggaccctgggtcatcgtcttccccagcctccaccaagggcccatcggtcttccccctggccg

SEQ ID NO: 529204 - DNA, 527 bp, Homo sapiens
  misc_feature: HEFZJCU01AQ0LL.8.34.D01.1.454.heavy.3.raw
ctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagacctaagtcctgaggacacggcgtatactactgtacgaaggaggggggaaccgagcgggaggttaccaagtacgtcctttacgg

SEQ ID NO: 529205 - DNA, 535 bp, Homo sapiens
  misc_feature: HEFZJCU01EVAEJ.16.86.H09.1.454.heavy.3.raw
  modified_base (509)..(509): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctcgattagcaggtggcttgggtcccatacgggttttgacttactggggggcccaggggaacncgtttggtccaccgtctcctcagcct

SEQ ID NO: 529206 - DNA, 528 bp, Homo sapiens
  misc_feature: HEFZJCU01BHX3T.52.57.F02.1.454.heavy.3.raw
cgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaagatcgaggtcgcatgacagtttttggagtggccaaagacggcaggttccgctacgggttggacgtctggggccaagggaccacggtcaccggtcgcctcagcctccaccaagggcccatcggtcttccccctggccaccctcctccaagagcacctctgggggccacagcggccctgggctgcctggtcaaggactacttcctatacgatcg

SEQ ID NO: 529207 - DNA, 547 bp, Homo sapiens
  misc_feature: HEFZJCU01BHVRC.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtctttttaagaggtgtccagagtcaggtgcagctggtggagtctgggggaggcgttgtccagcctgggaggtcgttgagactctcctgtcgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggcttggaccgctcgtttgacctacgtgggggcccgggggaggcccccgggttcatccggtcttcccg

SEQ ID NO: 529208 - DNA, 506 bp, Homo sapiens; identical to SEQ ID NO: 483205
  misc_feature: HEFZJCU01C6CNN.17.33.C11.1.454.heavy.3.raw

SEQ ID NO: 529209 - DNA, 507 bp, Homo sapiens
  misc_feature: HEFZJCU01DX4D2.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagcgtgaggtacgacggctggtgtattactagtgacgaaaggatttctatagaggtgacgtacc

SEQ ID NO: 529210 - DNA, 522 bp, Homo sapiens; identical to SEQ ID NO: 473464
  misc_feature: HEFZJCU01DL238.11.25.C03.1.454.heavy.3.raw

SEQ ID NO: 529211 - DNA, 482 bp, Homo sapiens
  misc_feature: HEFZJCU01B7XD5.47.59.F04.1.454.heavy.3.raw
  modified_base (447)..(447): a, c, t, g, unknown or other
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctcgacgagcacagcggcccngggctgcctggtcaaggactacttcctacgtgagc

SEQ ID NO: 529212 - DNA, 480 bp, Homo sapiens
  misc_feature: HEFZJCU01COIH7.40.83.H06.1.454.heavy.3.raw
tctagcgactcacgaccggtgctcgatttagatcacgtgcgtcgcgggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgacaaatgaacagcctgacagtcgaggacacggctgtatatttctgtgcgaatgaggaa

SEQ ID NO: 529213 - DNA, 536 bp, Homo sapiens
  misc_feature: HEFZJCU01BX2WO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgacgaccagacgacacggctgtctattattgcgcgagagagacacaccgaacctactggaccaatactatgggggcttgttctggggcaggggaccctggtctatcgtctccccacgcctccaccaacgggcccactcggtcttccccctggccgcccgtcg

SEQ ID NO: 529214 - DNA, 526 bp, Homo sapiens
  misc_feature: HEFZJCU01E0TEQ.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattccaccatctccagagacaactctaagaacacgctgtttcttcaaatgaacagcctgagagccgatgacacggccgtgtattactgtgcgagagagtgggcccacgaacgttactacgctatgacgtcgtggggccagggaccac

SEQ ID NO: 529215 - DNA, 493 bp, Homo sapiens
  misc_feature: HEFZJCU01EDNMO.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaaggccgattcaccatctccagagacaattccaagaacacgcagtatctgcaaatgaacagcctgagagctgaggacacggctgtgtattactgtgggagagagtggaggtcgatattgta

SEQ ID NO: 529216 - DNA, 520 bp, Homo sapiens
  misc_feature: HEFZJCU01B9XXU.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccattcagtagacacgtccaagaaccagctctccctgaagctgagttctgtgaccgccgcagacacggccgtgtattactgtgcgcgacaggtggacgtcgtgggccgaacgggaccacggtcgaaccgtcctccgtcacgcctccaccaaggggcccaacgttcc

SEQ ID NO: 529217 - DNA, 524 bp, Homo sapiens
  misc_feature: HEFZJCU01D77DN.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgtcgcgagagagacacacgaacctactggccaatactatgggggcttgttctgggggccagggggaccctggtcatcgtctccccagcctccaccaagggcccatcgtctccccctggccg

SEQ ID NO: 529218 - DNA, 522 bp, Homo sapiens
  misc_feature: HEFZJCU01ERXX8.49.38.D05.1.454.heavy.3.raw
agtcgagagacacgaccggtgctcgatttagtatctgatagttgggtttggggggggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacgg

SEQ ID NO: 529219 - DNA, 542 bp, Homo sapiens
  misc_feature: HEFZJCU01CTPIB.7.78.H01.1.454.heavy.3.raw
cgtgtctctacacgaccggtgctcgatttagtgtgagtagtttgggtttggggacccaacaaccacacccctcctaagaagaagcccctagacccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacaggggcggtttgtcttctccatggatacctctgtcgggacggcttatctgcagataaccaaccttcaacctgacgacactgccgtttatttttgtacgtagagcgtcgtctgtcagtggaattgactatcggggccagggaaccctgggtcctaccggtccttccctcaggtccctaccaccc

SEQ ID NO: 529220 - DNA, 517 bp, Homo sapiens
  misc_feature: HEFZJCU01AYIWP.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccaggggaggggcctgggagtgggtctcaggtatcagttacaatagtggtaatatactctatgcggactctgtgaagggccgattcaccatctccagagacaacgccaggaactccctctatctagaaatggacagtctgacaactgaggacacggccttttatttctgtgcaaaggtggaaccgacatatttcacaagctggcactggtacttcg

SEQ ID NO: 529221 - DNA, 494 bp, Homo sapiens
  misc_feature: HEFZJCU01BIG1C.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaacttccagaacacggtctatctgcacctgaccagcctgagaactgacgacacgtctctctactactgtgcgagagagttgacgagtcta

SEQ ID NO: 529222 - DNA, 351 bp, Homo sapiens
  misc_feature: HEFZJCU01DJ344.3.59.F04.1.454.heavy.3.raw
agacgcactccacgaccggtgctcgatttagtacacacacttagggattggggggaagaggaagactgacggtcctgccacaggtggtgctgggcacggtggacacgtccaacaacaacttctccctgaggctgacctctgtgaccgccgcagacacggccatttatcactgtgggagacaatgtagtggggtgactgccccgaatactggggccagggaacccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 529223 - DNA, 504 bp, Homo sapiens
  misc_feature: HEFZJCU01CWJ3Y.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagcgagacacggctctctattactgtgcgagagaccccgaaatacggtacgtacg

SEQ ID NO: 529224 - DNA, 527 bp, Homo sapiens
  misc_feature: HEFZJCU01B7N47.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaagtatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggattttccgttcaaatgaagtgtggttcgatgtgtttgattcg

SEQ ID NO: 529225 - DNA, 514 bp, Homo sapiens
  misc_feature: HEFZJCU01A1G8J.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaacggcccatcggtcttccccctggcaccctcctccaagagcacctcgtgggggcacgagcggccctgggcctgcctggtcaaggactactccgtactacg

SEQ ID NO: 529226 - DNA, 513 bp, Homo sapiens
  misc_feature: HEFZJCU01ADS7U.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacgagcggccctgggctgcctggtcaaggactacttccgagtgcgtct

SEQ ID NO: 529227 - DNA, 482 bp, Homo sapiens
  misc_feature: HEFZJCU01CMVB8.17.86.H09.1.454.heavy.3.raw
  modified_base (454)..(454): a, c, t, g, unknown or other
cgtagactagcacgaccggtgctcgatttagtgctatagacttgggtttggggtctgggagaggagccccagccctgagattcccaggtgtttccattcagtgatcagcactgaacacagaggactcaccatggagttgggactgagctggattttccttttggctactctaaaaggtgtccagtgtgaagtgcagctggtggagtctgggggaggctttggtacagcctggcaggtccctgagactctcctgtgcagcctctggattcacctttgatgattatggcatgcactgggtccgccaagccccagggaagggcctggagtgggtctcaggcattagttaggaatggtggtagcatagcctatgcggactccgtgaagggccgattcaccatctccagagacaacgccgaaaagttccctgtatctgcagatgaacagtctagagagntgaagacgacggccttatagtttctggt

SEQ ID NO: 529228 - DNA, 484 bp, Homo sapiens
  misc_feature: HEFZJCU01DYDZ0.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgacaatatgcagactccgtgaagggcgattcatcatctccagagacaactccaacaacacactggatctccaatgaacagcctgagagtcgaggacacggccgtagtattattgtgcccttgattacta

SEQ ID NO: 529229 - DNA, 409 bp, Homo sapiens
  misc_feature: HEFZJCU01DN3PA.52.87.H10.1.454.heavy.3.raw
cgcagtacgacacgaccggtgctcgatttagcagtactgcgttgggtttgggtccggcagcccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctggggcacagcggccctggctgcctggtcaaggactacttcctatacgatcg

SEQ ID NO: 529230 - DNA, 516 bp, Homo sapiens
  misc_feature: HEFZJCU01ECCI4.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtcgtcgggccgaaac

SEQ ID NO: 529231 - DNA, 515 bp, Homo sapiens
  misc_feature: HEFZJCU01EKB58.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgcctgctcaggagcacctccgagagcacagcggcccgtgggctcg

SEQ ID NO: 529232 - DNA, 500 bp, Homo sapiens; identical to SEQ ID NO: 503522
  misc_feature: HEFZJCU01D7CJF.14.55.E11.1.454.heavy.3.raw

SEQ ID NO: 529233 - DNA, 508 bp, Homo sapiens
  misc_feature: HEFZJCU01BGV6O.48.45.E01.1.454.heavy.3.raw
agtatacatacacgaccggtgctcgatttagtgagtcagtaagggaaaggggtctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaacgggccgattcaccatctccagagacaattccaacaagacactgtatctgcaaatgaacagcctgagggctgaagacacggctggtgtattactgtgcgaggaggctatcactatggttcggggttacg

SEQ ID NO: 529234 - DNA, 507 bp, Homo sapiens; identical to SEQ ID NO: 462344
  misc_feature: HEFZJCU01D4B8S.53.34.D01.1.454.heavy.3.raw

SEQ ID NO: 529235 - DNA, 516 bp, Homo sapiens
  misc_feature: HEFZJCU01AY7DK.48.23.C01.1.454.heavy.3.raw
agtatacatacacgaccggtgctcgatttagtacacgtgattaggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagccagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcgttttgattgcctttgattatggtgggggtccgaagggacgaagtggtccgaccgtt

SEQ ID NO: 529236 - DNA, 531 bp, Homo sapiens
  misc_feature: HEFZJCU01COARX.12.40.D07.1.454.heavy.3.raw
atacgacgtacacgaccggtgctcgatttagtgatagagcgtaacaacagagggctcaccatggagtttgggctgagctgggttttccttcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtccatcgtctccccagcctccaccaagggcccatcggtcttccccctggccgccctcg

SEQ ID NO: 529237 - DNA, 506 bp, Homo sapiens
  misc_feature: HEFZJCU01DAWBP.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgttctgcaatgagcagcctgaaagaagaggacacggctgtatataactgtgcgcgaggaccttattattatggttcagggaccattgactactcggggccagggaaccctggtcgaccgtctcctcacgcctccaccg

SEQ ID NO: 529238 - DNA, 512 bp, Homo sapiens
  misc_feature: HEFZJCU01EEVUR.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtcccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgacgtcagtgactatggtatggacgtctgggggccaacgggaccgacggtcatcgtctcctcagcctccaccaaggcccatcggtccttccccc

SEQ ID NO: 529239 - DNA, 500 bp, Homo sapiens
  misc_feature: HEFZJCU01A4I09.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttccccctggcgccctgctccaggagcacctccgagagcacagcggccctgggctgcctggtcaggactacttcctacgtcgtat

SEQ ID NO: 529240 - DNA, 545 bp, Homo sapiens
  misc_feature: HEFZJCU01EQSO2.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaatagactacggtgcacccgtgaaaggaagattcaccatctcaagagataattacaaaacgacggtgtatttgcaaatgaacagcctagaaaaccgaggacacagccgtctattactcgtaccacagattcggaagtgcatcgaacgtaaaggaggctatgtcttttgtatatctggggcccgagggac

SEQ ID NO: 529241 - DNA, 545 bp, Homo sapiens
  misc_feature: HEFZJCU01AQ0T5.4.66.F11.1.454.heavy.3.raw
agcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaagggctggagtgggtcggccatattaagcccaaaaactgaacgtggggaaacagactacgctgcacccgtgagaggcagattcaccatttcaagagatgattacaaaaagtacactgtatctggaaatgaacagcctgagaatcgacgacacacgccgtttattactgtacagaaagacgggcactagtcggtcccgtagggggcccaagggggaacccctgggtaccgacccggtcctcc

SEQ ID NO: 529242 - DNA, 501 bp, Homo sapiens
  misc_feature: HEFZJCU01BRMJY.47.56.F01.1.454.heavy.3.raw
  modified_base (482)..(482): a, c, t, g, unknown or other
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaaggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactgggngggaccgacttttatttcg

SEQ ID NO: 529243 - DNA, 498 bp, Homo sapiens
  misc_feature: HEFZJCU01AIBRV.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggccatcggtcttcccctgcgcctgctccaggagcacctccgagagcacagcggccctgggctgcctggtcaaggactacttccgtactacgacg

SEQ ID NO: 529244 - DNA, 507 bp, Homo sapiens
  misc_feature: HEFZJCU01EM7GF.4.81.H04.1.454.heavy.3.raw
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgatcagcctgagagtcgaggactcggctgtctactactgtgcgaggaataagggagctaccctacgatttggacact

SEQ ID NO: 529245 - DNA, 519 bp, Homo sapiens
  misc_feature: HEFZJCU01EGZ4Y.52.53.E09.1.454.heavy.3.raw
cgcagtacgacacgaccggtgctcgatttagagagagtgtgttgggtttggggagctctgggagaggagccccagccctgagattcccaggtgtttccattcagtgatcagcactgaacacagagggactcaccatggagttgggactgagctggattttccttttggctattttaaaaggtgtccagtgtgaagtgcagctggtggagtctgggggaggcgtggtacagcctggcgggtccctgagactctcctgtgcagcctctggattcagctttgatgaagacaacgccaagaactccctgtctctgcaaatgaacggactgagagttgaggacacgggcttctactattgtgcaaaaggccctgcccttttctattgatatcactgcttattactacacgccggttgactcctggggccagggaaccctggtcaccgtctcctcagcctccaccaagggcccatcggtccttccccctcggccaccctcctccaagacgcacctctgggggcac

SEQ ID NO: 529246 - DNA, 521 bp, Homo sapiens
  misc_feature: HEFZJCU01B8PIS.51.30.C08.1.454.heavy.3.raw
cgatcgtatacacgaccggtgctcgatttagtctgacgtcaaagggaaagggggggagaggagcccagcactagaagtcggcggtgtttccattcggtgatcagcactgaacacagacgactcaccatggactttgggctgagctgggttttcctcgttgctcttttaagaggtgtccactgtcaggtgcagttggtggagtctgggggaggcgcggtccagcctgggaggtccctgaggctctcctgcgcgtcctctggactccccttcagcacttatgacatgcactgggtccgccaggctccaggcaaggggctggagtgggtggcagtcatatcatatgatggaaaggataagtactatgcagactccatggaagggccgatccaccactctccagggacaattccaagaacacactgtatctgacaaataaacaacctagagagttgcggacacggctgtctattactgtgcggtacgtgggggactacggtgacgaacgtcactaccacctaccg

SEQ ID NO: 529247 - DNA, 498 bp, Homo sapiens; identical to SEQ ID NO: 502352
  misc_feature: HEFZJCU01EH5CH.11.71.G05.1.454.heavy.3.raw

SEQ ID NO: 529248 - DNA, 510 bp, Homo sapiens
  misc_feature: HEFZJCU01B3TNA.47.55.E11.1.454.heavy.3.raw
  modified_base (165)..(165): a, c, t, g, unknown or other
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttcctgttgctcttttaaaaggngtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaacccgtc

SEQ ID NO: 529249 - DNA, 518 bp, Homo sapiens; identical to SEQ ID NO: 449255
  misc_feature: HEFZJCU01E0J6K.3.17.B06.1.454.heavy.3.raw

SEQ ID NO: 529250 - DNA, 557 bp, Homo sapiens
  misc_feature: HEFZJCU01DC4Q4.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactcggccaatactagtgggggctttggttcgtgggggccgagggggacccgtggtcagttccgtctcccccacggtccctcccaccgaacggggccccagtccggtccttcccccgtcggccgcccgtcg

SEQ ID NO: 529251 - DNA, 510 bp, Homo sapiens
  misc_feature: HEFZJCU01CSYID.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactgggggcccggtagccctggt

SEQ ID NO: 529252 - DNA, 535 bp, Homo sapiens
  misc_feature: HEFZJCU01AWV80.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactggggtccgccaggctccagggaaggggctggagtgggttggccgttctagagacacaactaacagtgacaccgcacaatacgccgcgtctgtgaaaggcagattcaccatctcaagagatgattcagagaactcaactttatctgcaaatgaacagcctgagaaccgacgacaccggccgtcctattattggtgtcatacgacctagggattaaccgaaacgacgggtggtaacctgggtatttcc

SEQ ID NO: 529253 - DNA, 521 bp, Homo sapiens
  misc_feature: HEFZJCU01DM5QO.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggagggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagttggttactgttggacttacgtttacgactacgtggggccaggggaacccctggtaccg

SEQ ID NO: 529254 - DNA, 520 bp, Homo sapiens
  misc_feature: HEFZJCU01AIIIT.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatggcgctcccactacagtgcggccctccagagtcgagccctcatatccatagacacgtccaagaaccagttttccctgacgctgacgtctgtcgaccgccgcagacacggctgtctattattgtgcgagactagccttctgttaggtgggggtacttggcaacccgggatactactccaccttcggcttcggacatcgtggggccg

SEQ ID NO: 529255 - DNA, 517 bp, Homo sapiens
  misc_feature: HEFZJCU01CYGMH.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccaggggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccacgtggggccagggagccctggtccaccgtctccctcacg

SEQ ID NO: 529256 - DNA, 534 bp, Homo sapiens
  misc_feature: HEFZJCU01D6530.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttagagtggatgggaaggatcgtccctatcgttgacacaccaaactacgcacagaagttccagggcagactcaccataaccgcggaccaaattaacgaacacagttaatctggagctgaacagcctgtcatctgaggacacgggcttctacttctgtgcgaggagtaattactatacactgcttcttttacaccttcccttcgtacttctggggccatcggaaccccggtccg

SEQ ID NO: 529257 - DNA, 512 bp, Homo sapiens
  misc_feature: HEFZJCU01CKCWE.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagaccttaccatgaccacgaactcctccataaacacagcctacatggagttgaggagcctgacatctgacgacacggccgtctattactgtgcgagacgtcccacgatccggtgacgcctacggcaggcggcctttgactttcgtggggccagggg

SEQ ID NO: 529258 - DNA, 517 bp, Homo sapiens
  misc_feature: HEFZJCU01BOQJK.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccaggggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagatggggcccacgaacgttactacgctatggacgtctggggccaac

SEQ ID NO: 529259 - DNA, 510 bp, Homo sapiens
  misc_feature: HEFZJCU01DKFTH.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttcccctggcaccctcctccaagagcacctctgggggcacagcgcctggctgcctggtcaaggactacttccgagtgcgtct

SEQ ID NO: 529260 - DNA, 491 bp, Homo sapiens
  misc_feature: HEFZJCU01DPT6F.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataattatgcggactcgtgagggccgattcagcatctccagagacaacggcaagagtatactgtatctggaaatgaacatctgagagtcgacgatacggctgtctatcattgtgttttcgatgccttcggtccggcgggacttcgt

SEQ ID NO: 529261 - DNA, 506 bp, Homo sapiens
  misc_feature: HEFZJCU01BKBBI.51.30.C08.1.454.heavy.3.raw
cgatcgtatacacgaccggtgctcgatttagtctgacgtcaaagggaaaggggctgggagacgagcccagcactcgaagtcgccggtgtttccattcggtgatcatcactgaacacagaggactcaccatggagtttgggctgagctgggttttcctcgttgctctttaagaggtgtccagtgtcaggtgcggctggtggagtctgggggaggcgtggtccagcctggggattccctgagaatctcctgtgcagcctctggattcaacttcaatagacatcctatgcactgggtccgccaggctccaggcaaggggctggaatgggtggcagttatttcgtccactggaaacagtaaacattatggacgctccgtgaagggccattcgccatctccagagacaattccaaaaataccctctatctgcgaatgaacagcctgcgacctgaagacacggctatatatttctgtgcgagaggggagtcttattgtaatgatggttcctg

SEQ ID NO: 529262 - DNA, 524 bp, Homo sapiens
  misc_feature: HEFZJCU01C03IK.9.76.G10.1.454.heavy.3.raw
tgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaagtgcaactggtggagtctgggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaggaggggggagtacgagtggcagctccaagtactactttgtacttctgggccgac

SEQ ID NO: 529263 - DNA, 533 bp, Homo sapiens
  misc_feature: HEFZJCU01ECRDI.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagccttcggattccccttcagtagttattggatgacttgggtccgccagactccagggaaggggctggagtgggtggccaacataaagcaagatggaactgccgagtttacgtgactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagccctggtctaccg

SEQ ID NO: 529264 - DNA, 516 bp, Homo sapiens
  misc_feature: HEFZJCU01DCI85.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactgggggccggggaaccctggtcgccggtctcctcagcctccaccaagggcccatcggtcttccccctggcaccctcctccaagagcacctctgggggcacagcggccctgggctgcctgtcaggactactccagacgtata

SEQ ID NO: 529265 - DNA, 344 bp, Homo sapiens
  misc_feature: HEFZJCU01BYM7Q.52.78.H01.1.454.heavy.3.raw
cgcagtacgacacgaccggtgctcgatttagtgtgagtagtttgggtttggggctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccaggggaaggggctggagtgggtggccagcgtgaagca

SEQ ID NO: 529266 - DNA, 531 bp, Homo sapiens
  misc_feature: HEFZJCU01EFKPT.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttgcctggttattaccttgacacttggggccagggaaccctggtcaccgtctcctcagcctccaccaagggcccatcggtcttcccctggcgccctgctccaggagcacctccgagagcacacgcggccctcgggctgcctggtaaggactacttcctagtacg

SEQ ID NO: 529267 - DNA, 534 bp, Homo sapiens
  misc_feature: HEFZJCU01AU60V.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggccctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggacgtacggtgactacgtgggggttcgaccccgtggggccacggggaaccctggtccaccgtctcctcacgcctccacccg

SEQ ID NO: 529268 - DNA, 513 bp, Homo sapiens
  misc_feature: HEFZJCU01B7M42.49.82.H05.1.454.heavy.3.raw
agtcgagagacacgaccggtgctcgatttagtcgagctctctcgcgggcacgaccggtgctcgatttagagtgagctcgttgggtttggggctgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagacgccgaggacacggctgtgtatttactgtgcg

SEQ ID NO: 529269 - DNA, 483 bp, Homo sapiens
  misc_feature: HEFZJCU01D12F0.21.14.B03.1.454.heavy.3.raw
tcgtcgctcgcacgaccggtgctcgatttagtgtgagtagtttgggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggccaccctcctccaagacgcacctctgggggcacgagcggccctgggctgcctggtcaagggactacttcccgagcgacga

SEQ ID NO: 529270 - DNA, 480 bp, Homo sapiens
  misc_feature: HEFZJCU01DANU7.11.63.F08.1.454.heavy.3.raw
cgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaactatgcacagaagtttgagggtcagggtcatcatgaccagggacacgtccatcagcacagcctacatggagctgagcaggctgacatctgacgacgacggccgtgtattactgtgcgagagagtaaggggattgtgatagta

SEQ ID NO: 529271 - DNA, 529 bp, Homo sapiens
  misc_feature: HEFZJCU01A3TFU.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagtttattacgtcccttactttcgacttactggggccagggaactctggttcacccgtctcccgcacgcctccaccgaacgggcccattcc

SEQ ID NO: 529272 - DNA, 508 bp, Homo sapiens
  misc_feature: HEFZJCU01BBW2D.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacactccacgagcacagcctacatggaactgaggagcctgagatctgacgacaccggccgtatatttctgtcgcgagagacgtaaagtgacgtggtagttccgggggacacatgacaccg

SEQ ID NO: 529273 - DNA, 531 bp, Homo sapiens
  misc_feature: HEFZJCU01CZ29F.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaatggtggagttgggtccgccagcccccagggaaggggctggagtggattggggaaatctttcattagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggtttactctggttctaatgagttagttatgtctttgactattgggccagggaaccctggtcgaccgtcgtcctcac

SEQ ID NO: 529274 - DNA, 543 bp, Homo sapiens
  misc_feature: HEFZJCU01DHOOF.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattgggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggcccgtgtattactgtgcgagatgtggaaaaagtaatggctgtgtttattgggggccaggggagccccgtggtctaccg

SEQ ID NO: 529275 - DNA, 503 bp, Homo sapiens
  misc_feature: HEFZJCU01EPFHM.48.29.C07.1.454.heavy.3.raw
  modified_base (495)..(495): a, c, t, g, unknown or other
agtatacatacacgaccggtgctcgatttagagtgctacgaagggaaaggggggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgctaaaagttgtggagtcacagtctctggactacggtatggacgtctggggccaagggaccacggtcacagtctcctcagcctccaccacggcccatcggtcttcccctggcaccctcctccagagcacctctgggggcacgagcggcctgggctgcctggtcaggactcttacctntgtatact

SEQ ID NO: 529276 - DNA, 497 bp, Homo sapiens
  misc_feature: HEFZJCU01AQOAN.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattacgtgtgggagagagtgggaggtcgatagttgta

SEQ ID NO: 529277 - DNA, 523 bp, Homo sapiens
  misc_feature: HEFZJCU01DL864.48.5.A05.1.454.heavy.3.raw
agtatacatacacgaccggtgctcgatttagatagatagacagggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctgggagtgggtctcatctattagtgagactggtgatactacagactacgcagactccgtgaggggcccggttcaccgtctcccagagacaattccaagaacacgctatttctgcaaatgaacagcctgagagtcgacgacacggccgtatactactgtgcgagacagatgctgccgcctgtccgtgggccagggaaccctggtcaccgt

SEQ ID NO: 529278 - DNA, 520 bp, Homo sapiens; identical to SEQ ID NO: 449050
  misc_feature: HEFZJCU01ENJZ3.12.40.D07.1.454.heavy.3.raw

SEQ ID NO: 529279 - DNA, 510 bp, Homo sapiens
  misc_feature: HEFZJCU01CWRD9.49.81.H04.1.454.heavy.3.raw
  modified_base (466)..(466): a, c, t, g, unknown or other
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttnttactgtgcgaacttaatcacggaggacaaggggtgacccccgt

SEQ ID NO: 529280 - DNA, 517 bp, Homo sapiens
  misc_feature: HEFZJCU01BHE3Z.10.38.D05.1.454.heavy.3.raw
  modified_base (419)..(419): a, c, t, g, unknown or other
catagtagtgcacgaccggtgctcgatttagtatctgatagttgggttttccttgttgctatttcaaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtcnccccagcctccaccaagggcccatcggtccttcccccgtggccgccctgcctccaggtagcacctccgagagcacacgcggcccgtcgggctcgcctc

SEQ ID NO: 529281 - DNA, 521 bp, Homo sapiens
  misc_feature: HEFZJCU01BLPK1.10.85.H08.1.454.heavy.3.raw
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatattttctgtgcggaggggagccggctagtggttcggacctcgtggggccaggggtaaccc

SEQ ID NO: 529282 - DNA, 502 bp, Homo sapiens
  misc_feature: HEFZJCU01BEZEF.52.42.D09.1.454.heavy.3.raw
cgcagtacgacacgaccggtgctcgatttagacacatacgcagggaaaggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaatgaacagcctgagagctgaggacacggctatgttttactgtgcgagagggaactcgattacagcagcctacg

SEQ ID NO: 529283 - DNA, 499 bp, Homo sapiens
  misc_feature: HEFZJCU01EJMXD.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtcgacccctgactgataaaccggactggttcgaccctggggccgagggacccggtcaccgtctcctc

SEQ ID NO: 529284 - DNA, 508 bp, Homo sapiens
  misc_feature: HEFZJCU01C32FE.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggcccattggttaccggcacacaaatcaggcaagtcctacgacggtctggtacg

SEQ ID NO: 529285 - DNA, 520 bp, Homo sapiens
  misc_feature: HEFZJCU01AWZXR.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgacaatgaacaccctgcgagccgagacacggccgtatattactgtgcgagaataaccgttcgcctggttatttaccg

SEQ ID NO: 529286 - DNA, 513 bp, Homo sapiens
  misc_feature: HEFZJCU01AIG9F.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgttattactgtgcgagagagtggggcccacgaacgttactaccgctatggacgtcgtggggg

SEQ ID NO: 529287 - DNA, 397 bp, Homo sapiens; identical to SEQ ID NO: 450361
  misc_feature: HEFZJCU01DIXX8.47.46.E02.1.454.heavy.3.raw

SEQ ID NO: 529288 - DNA, 511 bp, Homo sapiens
  misc_feature: HEFZJCU01C45FV.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatgggcactacatattattctgactccgtgaagggccggttcacccctctccagagacacttccaacaacatcttgtatcttcacatgcacaatctgagagtcgacgacacggccacctatttattgtgcgcgactatcgactacgctcaattctggggccaggggacg

SEQ ID NO: 529289 - DNA, 519 bp, Homo sapiens
  misc_feature: HEFZJCU01C9MQP.52.83.H06.1.454.heavy.3.raw
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctctttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaacgggccgattcaccatctccagagacaattccaagaatacgctgtatctgcacatgaacagcctgagacgccgaagacacgggtggtttattacgtgtacgaacttaattacggaggacaaccggtaaccccgtccgcgacgcac

SEQ ID NO: 529290 - DNA, 531 bp, Homo sapiens
  misc_feature: HEFZJCU01EGU78.49.57.F02.1.454.heavy.3.raw
agtcgagagacacgaccggtgctcgatttagctcgatatagttgggtttgggtagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagttaccgttcgacccctggggccagggagccctggtcaccgtctcctcagtcttccaccaacggcccatccggtccttccccctcggccgtccctcgcctccgac

SEQ ID NO: 529291 - DNA, 512 bp, Homo sapiens; identical to SEQ ID NO: 446702
  misc_feature: HEFZJCU01BEXXV.14.25.C03.1.454.heavy.3.raw

SEQ ID NO: 529292 - DNA, 503 bp, Homo sapiens
  misc_feature: HEFZJCU01BN0XF.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcacgtctcctcagcttccaccaagggcccatcggtcttcccctggcgcctgctccaggagcacctctggggcac

SEQ ID NO: 529293 - DNA, 522 bp, Homo sapiens
  misc_feature: HEFZJCU01EDQ11.9.70.G04.1.454.heavy.3.raw
  modified_base (345)..(345): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctnaagagtcgagtcagcatgtcaggtcgacaccgtcccagaaccagttctccctgacagtgagttatatgaccgccgcagacacggcgtgtattactgtgcgagagagggccgtttattttaggaccagctagttaaaactcctaactacggtctggacgtctgtcgccgaggggaccg

SEQ ID NO: 529294 - DNA, 494 bp, Homo sapiens
  misc_feature: HEFZJCU01AJ4ML.40.1.A01.1.454.heavy.3.raw
tctagcgactcacgaccggtgctcgatttagacgtctcatcaggggagctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctggggaggtccctgagactctcctgtgcagcctctggattcattttcagtaactatgctatgcactgggtccgccagactccgggcaaggggctggagtgggtggcaattatctcatatgatgaaagtcaagaatactacgcagactccgtgaagggccgattcaccatctccagagacaattccaagaacacactgaatctacaaatgaacaagcctcagacctgaggactcggctgtctatttctgtgcgagaggggtgactatcgatt

SEQ ID NO: 529295 - DNA, 499 bp, Homo sapiens
  misc_feature: HEFZJCU01ANZ4Z.53.26.C04.1.454.heavy.3.raw
cgcgtatacacacgaccggtgctcgatttagtctagcgactttgggtttggggggcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccgagggacgagggcccatcagaacagcctacagtggagctgaacagactgacatctgacgacacggtccgtttattattgtgtgagaggaggacccgatgacctcgg

SEQ ID NO: 529296 - DNA, 496 bp, Homo sapiens
  misc_feature: HEFZJCU01DAJG5.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagttgggctggaatccgtcagcccccaggaaagccctggagtggcttgcgctcatttattgggatgagagtaagcactacagtccgtctctgaagaacaggctcaccatcaaccaaggacacctccacaaaccaggtggtacctacaatcgaccaatatgacctgtggaccgtacacgccaccatattacttgttcgacgctcctaatgggtttccgggggagtttaagttagtcccttacgtttacgtaactaccgttcggggg

SEQ ID NO: 529297 - DNA, 541 bp, Homo sapiens
  misc_feature: HEFZJCU01EJRQ3.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggagtcggggagtttggttctggggccagggaaccctggtccg

SEQ ID NO: 529298 - DNA, 528 bp, Homo sapiens
  misc_feature: HEFZJCU01DCF9L.8.39.D06.1.454.heavy.3.raw
ctcgcgtgtccacgaccggtgctcgatttagtgacatctcgcagttctttgggttttggggggaagaggaagactgacggtcccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcaacggagcttttgaattttggggccgaagggacaatggtcatcgtctccgtcagcctccaccgaacgggcccactcggtcttccccctggccaccctcctacc

SEQ ID NO: 529299 - DNA, 513 bp, Homo sapiens
  misc_feature: HEFZJCU01B13F5.21.23.C01.1.454.heavy.3.raw
tcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcgaacggccccagaactggaactacgccagtggacgtcgtggggcaaac

SEQ ID NO: 529300 - DNA, 477 bp, Homo sapiens
  misc_feature: HEFZJCU01DG5A5.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtcatcagcacagcctacatggacctgagcggcctgacatctgacgacacggccgtatatttctgtgcgaggg

SEQ ID NO: 529301 - DNA, 502 bp, Homo sapiens
  misc_feature: HEFZJCU01CDDXC.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacggtccgtcaggacagcctatatggaggtgaccagcctgagcctgacgacacggccatatatttctgtgcgcgaggaatttcgacttctgaataattacttgggttagaactacctt

SEQ ID NO: 529302 - DNA, 503 bp, Homo sapiens
  misc_feature: HEFZJCU01BR736.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgagggccgattcagcatctccagagacaacggcaagagtatactgtatctggaatgaacaatctgagagtcgacgatacggctgtctatcattgtagtttcgatgctcgtccgcggtactcgtgggccgagggaccctc

SEQ ID NO: 529303 - DNA, 555 bp, Homo sapiens
  misc_feature: HEFZJCU01E0FQ9.12.40.D07.1.454.heavy.3.raw
atacgacgtacacgaccggtgctcgatttagtgatagagcgtaacaacagagggctcaccatggagtttgggctgagctgggttttcctcgttgctctttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaaacaccctttatcttacaaatagacagcctgagaccagacgacacggctgtctattattgcgcgagagagacacacgaacctactggaccaatactatgggggcttggttctgggggccgagggggacccgtggtcagttcgtcttccccagccctccaacccgaagggcccagtccgggtcctttccccctcggccgccccgtcgt

SEQ ID NO: 529304 - DNA, 507 bp, Homo sapiens
  misc_feature: HEFZJCU01D9GFC.3.17.B06.1.454.heavy.3.raw
  modified_base (436)..(436): a, c, t, g, unknown or other
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcacctggtggagtctggggggaggcttggtccagcctggagggtccctaagactctcctgtgcagcctctggactcaccttcacgctcaatggccactacgtggactgggtccgccaggctccagggaaggggctgggatggggttggccgttctagagacacaactaacagtgacaccgcacaatacgccgcgtctgtgaaaggcagattcaccatctcaagagatgattcagagaactcactttanctgcaaatgaacagcctgagaaccgacgacacggccgtctattattgtgtcatagacctaggatacaacga

SEQ ID NO: 529305 - DNA, 383 bp, Homo sapiens; identical to SEQ ID NO: 453289
  misc_feature: HEFZJCU01B4Y9X.11.61.F06.1.454.heavy.3.raw

SEQ ID NO: 529306 - DNA, 532 bp, Homo sapiens
  misc_feature: HEFZJCU01ANUQB.48.19.B08.1.454.heavy.3.raw
  modified_base (514)..(514): a, c, t, g, unknown or other
agtatacatacacgaccggtgctcgatttagtgagtcagtaagggggggatcgtcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctcctgaagctgagctctgtgaccgccgcagacacggctgtgtattactgtgcggagggggccgggatattgttatagaccacctgctatctgagcgtggttcgactgcgtcgggggccaaggggaaccctgggtcctaccggtctccctnacgccctaccacccgaac

SEQ ID NO: 529307 - DNA, 507 bp, Homo sapiens
  misc_feature: HEFZJCU01AQDUL.12.73.G07.1.454.heavy.3.raw
atacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccgccagactcctgggaaggggctggagtgggtctcattcatcagtagtgccaacaattacatttactacgccgactcagtgaagggccggttcaccatctccagagacaacgccaatgactcactgaatctgcaactgaaagcctgagagccgaggacacggcaatttatttctgtgcgagtaagtttagaggaacgcagataaggagggggggcagtgg

SEQ ID NO: 529308 - DNA, 537 bp, Homo sapiens
  misc_feature: HEFZJCU01CHCR2.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaactgaccgctgtgacgccgcggacacggctgtgtattactgtgcgagacgaatgggcgggtggctacgacttgacttttggggccgagggaaacctcggtcaccggtctccccagccgtttcccaccgtaacgggcccactcggtcctttcccccg

SEQ ID NO: 529309 - DNA, 495 bp, Homo sapiens
  misc_feature: HEFZJCU01EMC68.49.47.E03.1.454.heavy.3.raw
  modified_base (463)..(463): a, c, t, g, unknown or other
  modified_base (492)..(492): a, c, t, g, unknown or other
agtcgagagacacgaccggtgctcgatttagactcgcgcacagagagaagggggcatcatccaacaaccacatcccttctctacagaagcctctgagagggaagttctttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgngagtcactcattaactacgtaatgtttanggt

SEQ ID NO: 529310 - DNA, 523 bp, Homo sapiens
  misc_feature: HEFZJCU01BBNJ6.3.17.B06.1.454.heavy.3.raw
  modified_base (303)..(303): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccacggntcccccagggaaggggctggagtgggttggccgttctagagacacaactaacagtgacaccgcacaatacgccgcgtctgtgaaaggcagattcaccactctcaagagatgattcagagaactcactttatctgcaaatgaacagcctgagaaccgacgacacggccgtctattattgtgtcatagacctaggatacaacgacggtggtacctggtattc

SEQ ID NO: 529311 - DNA, 487 bp, Homo sapiens
  misc_feature: HEFZJCU01C3IUY.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctcctgcagctgacctctgtgactcccgaggacacgggtgtagtattacgtgtggtaagacggcccccataacg

SEQ ID NO: 529312 - DNA, 515 bp, Homo sapiens
  misc_feature: HEFZJCU01DYPMO.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagaccgaccgacaccggccatatattactgtgcgaaagcaccggcagttgtacacccatactactttgactacgtggggaccg

SEQ ID NO: 529313 - DNA, 534 bp, Homo sapiens
  misc_feature: HEFZJCU01BRCAC.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactaggccaatactatcggggggcttggttctgggggccaggggaccctgggtcatcgtctccccagcctccaccaagggcccatcggtcctcccctggccgccctcg

SEQ ID NO: 529314 - DNA, 505 bp, Homo sapiens
  misc_feature: HEFZJCU01DF7EI.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagtttgagcagcctggagatctgacgacacgggccgtttacttactgtgcgcgagataatagtcacaactggaacggtcgttttggggtggttc

SEQ ID NO: 529315 - DNA, 512 bp, Homo sapiens
  misc_feature: HEFZJCU01A3XEO.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccaggggaaccctggtcaccgtctcctcagcctccaccaagggcccatcggtcttccccctggccaccctcctccaagagcacctctgggggcacagcggccctgggctgcctggtcaaggactacttcctacgtcgtat

SEQ ID NO: 529316 - DNA, 538 bp, Homo sapiens
  misc_feature: HEFZJCU01EOFPR.49.55.E11.1.454.heavy.3.raw
agtcgagagacacgaccggtgctcgatttagcactcgcacgttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaataaacagcctgagagccgaggacacggctgtgtattactgtgcgagagatcccccgggtatagcagtgtctggtacatattactggggccaggggaaccctggtcaccggtctcctcagcctccaccaagggcccatcggtcttcccctggccgccctcgctccaggacgcaccctccgagagccacagccggtccc

SEQ ID NO: 529317 - DNA, 540 bp, Homo sapiens
  misc_feature: HEFZJCU01CG9KL.7.78.H01.1.454.heavy.3.raw
  modified_base (524)..(524): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggttgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggattgactactgggggccaggggaaccctggtccaccgtctacctcanccgtccaccgaacggg

SEQ ID NO: 529318 - DNA, 507 bp, Homo sapiens
  misc_feature: HEFZJCU01DKN09.48.73.G07.1.454.heavy.3.raw
agtatacatacacgaccggtgctcgatttagctctacgctcagggcacgaccggtgctcgatttagtatctgatagttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaccagttcctccctgaggctgagctctgtgaccgccgcagacacggctgtctattactgtgcgagaagtgggtcgtggcagtggctggtacgtggt

SEQ ID NO: 529319 - DNA, 539 bp, Homo sapiens
  misc_feature: HEFZJCU01AIDIL.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtggtggggcatttacttgacccctgggggcccggggaacccgtggtccaccgtcctccccacccctccaacccgg

SEQ ID NO: 529320 - DNA, 555 bp, Homo sapiens
  misc_feature: HEFZJCU01EAHCT.53.68.G02.1.454.heavy.3.raw
  modified_base (365)..(365): a, c, t, g, unknown or other
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggcccccagggaaggggctggagtggatagcggaaatcaatcatagtggaaagactacctacaacccgtccctcaagagtcgagtcaccttatcggtagacacgcccaagaagcagttctccctgagggtnacgtctgtgaccgccgcggacacggctgtctattactgtgcgagaggccccttagtttcggtttttggactggttctcccatggaatccctactttgagtacgtgggggccgcggacgcccgtggtactccgtccttcctcacgcctcccaccgaaccgggccctacgtccggttcccttcccccgtcgg

SEQ ID NO: 529321 - DNA, 513 bp, Homo sapiens
  misc_feature: HEFZJCU01DVEIA.8.34.D01.1.454.heavy.3.raw
ctcgcgtgtccacgaccggtgctcgatttagatcgtctgtgtcgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacgacgggcgtatactactgtacgaagggaaggggggaaccagcgggagttccaagtactcctttg

SEQ ID NO: 529322 - DNA, 506 bp, Homo sapiens
  misc_feature: HEFZJCU01AEUTX.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacgatgatggaactaatagacgctatgccgactccgtgaagggccgattcaccatctccagagacaattcccaagaacacgcagtatctgcaaatgaacagcctgagagctgaggacacgggctgttgtattacgtggtgggaagagagtgggaggtcgattagttgttaa

SEQ ID NO: 529323 - DNA, 516 bp, Homo sapiens
  misc_feature: HEFZJCU01BN9CE.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacactggagttgaggagcctggacatctggacgacacggcccgtctacttactgtgcgaggagtcccacgatccgggtgacgccgtacggccaggcggccctttgacttcgtc

SEQ ID NO: 529324 - DNA, 545 bp, Homo sapiens
  misc_feature: HEFZJCU01CVBER.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctccggatttgtttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagaggccgaggacacgggctggtattattatttggtgtgagtattaggcgcacttactttgactacgtgggggccaggggtaaccctggtccaccggtcct

SEQ ID NO: 529325 - DNA, 503 bp, Homo sapiens
  misc_feature: HEFZJCU01BL2U3.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcgagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgacggaaagatttactatagaggtgactacc

SEQ ID NO: 529326 - DNA, 514 bp, Homo sapiens
  misc_feature: HEFZJCU01DDHRC.47.48.E04.1.454.heavy.3.raw
  modified_base (445)..(445): a, c, t, g, unknown or other
  modified_base (466)..(466): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccaatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaaggccgattcaccatctccagagacaacgccaagaactctctgtttctgcaaatggacagcctganggtcgaaagacacgggctgtntattactgtgtgttctctgacggcctcggccggacctttggctttcgg

SEQ ID NO: 529327 - DNA, 510 bp, Homo sapiens
  misc_feature: HEFZJCU01D82VF.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaggaggggggagtacgagtggcagctccaagtacttac

SEQ ID NO: 529328 - DNA, 523 bp, Homo sapiens
  misc_feature: HEFZJCU01EBAHE.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctggacgcgtcccgcaatacagcctccatggaattgaccacactgaaatctgacgacacggccgtctactattgtgcggagggtcaatagtcttaccataaacggtgcccggacagatgatttttggatgtctggggccaaggtacagcggtcaccgtcgcctcacgcctccaccaagggcccatcggtcttccccgtgccaccctcctcaagacgcacctcgtgggggcacgac

SEQ ID NO: 529329 - DNA, 506 bp, Homo sapiens
  misc_feature: HEFZJCU01A97KC.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggtcctttgacttcgtc

SEQ ID NO: 529330 - DNA, 517 bp, Homo sapiens
  misc_feature: HEFZJCU01BAK3K.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcacccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccgagggaaggggctggagtgggtggccaacatagagtacgatggaagtgagaaaactatgtggactccgtgaagggccgattcaccatctccagagacaacgacaagaatttagtgtatctgcaatgagcagcctgagagccgaggacacggctgtgtattattgtg

SEQ ID NO: 529331 - DNA, 513 bp, Homo sapiens
  misc_feature: HEFZJCU01DGXP2.17.25.C03.1.454.heavy.3.raw
  modified_base (451)..(451): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcganaggtcccacgatccggtgacgcctacggcaggcggcctttgacttcgtggggccaggggacg

SEQ ID NO: 529332 - DNA, 496 bp, Homo sapiens
  misc_feature: HEFZJCU01BBT67.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcgagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttccccctggcgccctgctccaggagcacctccgagagcacagcggccctgggctgcctggtcaaggactactcctacgtgagctctgtac

SEQ ID NO: 529333 - DNA, 514 bp, Homo sapiens
  misc_feature: HEFZJCU01D1BRB.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcacggcagttagtcaacccatactactttgacttacgtcgggtccaac

SEQ ID NO: 529334 - DNA, 505 bp, Homo sapiens
  misc_feature: HEFZJCU01DEBDI.49.53.E09.1.454.heavy.3.raw
agtcgagagacacgaccggtgctcgatttagagagagtgtgttgggtttggggacccaacaaccacatccctcctcagaagcccccagagcacaacgcctcaccatggactggacctggaggatcctctttttggtggcagcagccacaggtgcccactcccaggtccaacttgtgcagtctggggctgagttgaagaagcctggggcctcagtgaaggtttcctgcacggtttctggataccccctcagcagtcatgctatgcattgggtgcgccaggcccccggacaaaggtttgagtggatgggatggatcaccgctggcaatggtgacacaaatattcacaaaagttccagggcagagtcaccatttacagggacacatctgcgagttcaggctacatggaactgagcggcctgagatatgaggacacggctatttattactgtgcgagagggaatgggatattgtgtcagctccaggtgcccgagcccggcccctacttt

SEQ ID NO: 529335 - DNA, 513 bp, Homo sapiens
  misc_feature: HEFZJCU01BHZRN.51.9.A09.1.454.heavy.3.raw
  modified_base (491)..(491): a, c, t, g, unknown or other
cgatcgtatacacgaccggtgctcgatttagcgagacgcgcaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggagaccggctatttattactggtgtcggagaggggaagtggggactattgtggctaggcttccagggttncccgaagcccggcccccttacg

SEQ ID NO: 529336 - DNA, 532 bp, Homo sapiens
  misc_feature: HEFZJCU01AVR4B.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgatccgggggaggcctggtccagcctgggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgattactgtgcgagatgtggaaaagtatggctgtgtttatggggccagggagccctggtctaccg

SEQ ID NO: 529337 - DNA, 539 bp, Homo sapiens
  misc_feature: HEFZJCU01CI67A.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccacctggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagaggccgaggacacggccatgtattactgtgtgggggcatttacttgacccctgggggcccggggaacccgtggtccaccggtctccccaccctcccaccg

SEQ ID NO: 529338 - DNA, 490 bp, Homo sapiens
  misc_feature: HEFZJCU01EGCRJ.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtcgtcccttgatttacta

SEQ ID NO: 529339 - DNA, 518 bp, Homo sapiens; identical to SEQ ID NO: 469127
  misc_feature: HEFZJCU01AZ0SN.15.16.B05.1.454.heavy.3.raw

SEQ ID NO: 529340 - DNA, 400 bp, Homo sapiens; identical to SEQ ID NO: 444452
  misc_feature: HEFZJCU01BVD11.47.24.C02.1.454.heavy.3.raw

SEQ ID NO: 529341 - DNA, 513 bp, Homo sapiens
  misc_feature: HEFZJCU01DSD7N.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactagtgacgaaaggcaccggcagttagtcacccatactactttgactactggggaccg

SEQ ID NO: 529342 - DNA, 532 bp, Homo sapiens
  misc_feature: HEFZJCU01CFBSA.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccactaggtttgacttacgtgggggccaggggaagcttggtccaccgtctccctcacgcctcccg

SEQ ID NO: 529343 - DNA, 481 bp, Homo sapiens
  misc_feature: HEFZJCU01CY6OV.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtttcaacttttagtggtagtggtggtcacgcctactacgcagagtccgtgaaggggccgattcaccatctccagagacacttccgagaacacgctgtatctgcgaatgaaacagcctgagagtcgaggacacggcccatatattactgtgcgaaagatcctgaggcctataccacctcagtcagctggttcgacccctggggccagggaaccctggtcaccgtctcctcagcctccaccaagggcccatcggtcttccccctggcaccctccctccaagagcacctctgggggcacagcggccctgggctgcctggtcaaggactacttccgagtagtaca

SEQ ID NO: 529344 - DNA, 520 bp, Homo sapiens
  misc_feature: HEFZJCU01AHO38.16.71.G05.1.454.heavy.3.raw
  modified_base (461)..(461): a, c, t, g, unknown or other
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaaccatctccagagacaattccaagaacacactgtatctgcaaatgaacagacctgagagccgacgacacggccatatattactntgcgaaagcaccggcagttagtcacccataccttactttagactactcggggtaccaac

SEQ ID NO: 529345 - DNA, 520 bp, Homo sapiens
  misc_feature: HEFZJCU01CEZSM.49.57.F02.1.454.heavy.3.raw
  modified_base (452)..(452): a, c, t, g, unknown or other
agtcgagagacacgaccggtgctcgatttagctcgatatagttgggtttggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctnaggacacggctatgtattactgtgtgaaagacttttaatgacagtagtggtttctccgagtatggcta

SEQ ID NO: 529346 - DNA, 510 bp, Homo sapiens
  misc_feature: HEFZJCU01DT9F2.21.23.C01.1.454.heavy.3.raw
tcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagccccaagaactggaactacgccatggacgtctggggcgaaac

SEQ ID NO: 529347 - DNA, 518 bp, Homo sapiens; identical to SEQ ID NO: 444718
  misc_feature: HEFZJCU01CSRNK.9.34.D01.1.454.heavy.3.raw

SEQ ID NO: 529348 - DNA, 503 bp, Homo sapiens
  misc_feature: HEFZJCU01BJLIJ.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctgggacggtccctgagactctcctgtgcagcctctggatacatcttcaaaagtttcgaaatgagctgggtccgccaggctcctgggaagggggccggagtggatttcatacatcagtagtagtggtaacaccttgtactatgcagactctgtgaagggccgattcaccatctccagagacaacgccaagaattcactgtttctgcaaatgaacagcctgagagacgaggaatacggctatttactattgtgcgcgatcgacaagaaaagcggtggcctagtc

SEQ ID NO: 529349 - DNA, 498 bp, Homo sapiens
  misc_feature: HEFZJCU01DH7OH.53.29.C07.1.454.heavy.3.raw
cgcgtatacacacgaccggtgctcgatttagagtgctacgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatgggagctgaccaggctgaaatttgaggacacggccatttattactgtgcaaggaacagcataatgactcgtccccggacttgtac

SEQ ID NO: 529350 - DNA, 486 bp, Homo sapiens
  misc_feature: HEFZJCU01E1JL0.8.39.D06.1.454.heavy.3.raw
ctcgcgtgtccacgaccggtgctcgatttagtgacatctcgcagtttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtactatatggagatgaggagcctgagacttgacgacacggccgtatattactgtgcgagaatcgaagaaggtggctac

SEQ ID NO: 529351 - DNA, 517 bp, Homo sapiens
  misc_feature: HEFZJCU01A2BN3.48.81.H04.1.454.heavy.3.raw
agtatacatacacgaccggtgctcgatttagtagtgtagattcgcgggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcaggaatcacacttaccgcggacaaatccacgggcacagcgcagttggacctgagcggcctggagacctgaggacacggccattactactgtgcgcggggaggtcggacggagctcgggttttccggagtttacgtcatacttactactttgtaatt

SEQ ID NO: 529352 - DNA, 525 bp, Homo sapiens
  misc_feature: HEFZJCU01D1IB3.53.10.A10.1.454.heavy.3.raw
cgcgtatacacacgaccggtgctcgatttagcgtcgatctcagggtcttcgtggctcacgtccaccaccacgcatgtgacctcagggggtccctgagactctcctgtgcagcctctggatttaacttcagaacctatgacatggaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaaggacacggcggtctatttctgcgcgaggaaaagtcgcattccagagcctgtacgcccgccttggtctcgtcagttggtcaatccgccctccaggggggacctttgggggtttcgacccctggggccagggaaccctggtcaccgtctcctcagcctccaccaagggccatcggtcttcccctcggcaccctcctccaagacgcacctctcgggggg

SEQ ID NO: 529353 - DNA, 521 bp, Homo sapiens
  misc_feature: HEFZJCU01DDOCR.12.40.D07.1.454.heavy.3.raw
  modified_base (489)..(489): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaaacctactggccaatactatgggggcttgttctgggggccaggggaccctggtcatcgtctccccngcctcaccaagggcccatcgtctccccgtgcg

SEQ ID NO: 529354 - DNA, 503 bp, Homo sapiens
  misc_feature: HEFZJCU01CN3RL.49.82.H05.1.454.heavy.3.raw
agtcgagagacacgaccggtgctcgatttagtcgagctctctcgcgggggaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaaggactggagtgggtttcatacattagtcggagagtcaacaccgtattctacacagactctgtgaggggccgattcaccatcctccagagacaacgccaagaactcactgtatctccaaatgaacagcctgagagtcggaggacacggctgtctattactgtgcgagagatcccaaacagcggctgggtactttgacttac

SEQ ID NO: 529355 - DNA, 549 bp, Homo sapiens
  misc_feature: HEFZJCU01ANG3F.11.25.C03.1.454.heavy.3.raw
  modified_base (421)..(421): a, c, t, g, unknown or other
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctcgtgggttcaccgtcagtcacacctacatgagttgggtccgccaggctccagggaaggggctggagtgggtctcctttatttacagcagtggtagtacatattccgcagactccgtgaggggccgattccaccatctccagagacaactctaagaacacgctgttctnaatgaacagcctgagagccgatgacacggccgtgtattactgtgcgagagagtcgggggccccacggaaccgttactaccggtctaagtgggaccggttcgtgggggtaccgaaggggtaaccctacc

SEQ ID NO: 529356 - DNA, 519 bp, Homo sapiens
  misc_feature: HEFZJCU01B4S53.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtcttccccctggcaccctcctccaacgagcacctctgggggcacagcggccctgggctgcctggtcaaggactacttccagacgtatca

SEQ ID NO: 529357 - DNA, 516 bp, Homo sapiens
  misc_feature: HEFZJCU01AYPNS.51.12.B01.1.454.heavy.3.raw
cgatcgtatacacgaccggtgctcgatttagtagtgtagattccgcgggggagagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttcgacgacacggccgtctattactgtgcgacagaagcggtcggacagaggtttcgcttactggtttcgaggctctacccccg

SEQ ID NO: 529358 - DNA, 512 bp, Homo sapiens
  misc_feature: HEFZJCU01ECFSP.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactgggggcccgggagccccgtggt

SEQ ID NO: 529359 - DNA, 501 bp, Homo sapiens; identical to SEQ ID NO: 457766
  misc_feature: HEFZJCU01CYJVD.11.27.C05.1.454.heavy.3.raw

SEQ ID NO: 529360 - DNA, 494 bp, Homo sapiens
  misc_feature: HEFZJCU01E1IJL.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcgggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatcctccagagacaattcccagaaccacggtctatctgcacctgaccagcctgagaactgacgacacgtctctctactactgtgcgagagagttgacgagt

SEQ ID NO: 529361 - DNA, 487 bp, Homo sapiens
  misc_feature: HEFZJCU01DKXJH.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacaccgtccatcagcacagcctacactggagctacacggcctgagatctgacgacacggccctgtatttttgtgcgagagagtctattaaagtggc

SEQ ID NO: 529362 - DNA, 509 bp, Homo sapiens
  misc_feature: HEFZJCU01DHHDQ.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatccaccagggggctccacactcgaccctgggccaggggaaccctaagtcaccgtcctcctcacgcctccaccaacgggcccactcggtcttcccctggccgcctcgctccaggacgcacctccgagacgc

SEQ ID NO: 529363 - DNA, 535 bp, Homo sapiens
  misc_feature: HEFZJCU01B5Q58.52.9.A09.1.454.heavy.3.raw
  modified_base (461)..(461): a, c, t, g, unknown or other
cgcagtacgacacgaccggtgctcgatttagcgagacgcgcaggggggctctgggagaggagccccagccgtgagattcccaggagtttccacttggtgatcagcactgaacacagaccaccaaccatggagtttgggcttagttgggttttccttgttgctattttaaaaggtgtccagtgtgaggtgcagctggtggagtctggggggaggcttggtacagccagggcggtccctggagactctcctgtacagcttctggattcacctttggtgattatgctatgacatgggtccgccaggctccggggaaggggctgggagtgggtaggtttctctagaagcaaatcctatgggtgggacaacagaatacgccgcgtctgtggaaggcagattcaccatctcaagagatgattcccaaaggcatcgcctatctgcaaatgaagagcctagaaaaccgnggaacacagccgtgtacttctgtactaggacgttcttcttgttattatttatgaaacttgtggtttattcgtaa

SEQ ID NO: 529364 - DNA, 521 bp, Homo sapiens
  misc_feature: HEFZJCU01D3Y0L.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctggggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgatttcgatccctccgcagtcgacactttgattactggggccggggaacccgtggtcgccgtctcctcagcctccaccaagggcccatcggtcttccccctggccaccctcctccaagagcacctctgggggcacagccggccctggctgcctggtcaaggactacttccagacgtatca

SEQ ID NO: 529365 - DNA, 542 bp, Homo sapiens
  misc_feature: HEFZJCU01DF51R.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggaacgcggctgtttattactgtgcgcggtggctgaccgtctcttcgactacgtcgggggccgggggacggtccccgggtcagtccgtcttccc

SEQ ID NO: 529366 - DNA, 547 bp, Homo sapiens
  misc_feature: HEFZJCU01B1IK2.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaagggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttaccacccttacccttgtacctttcgttggggccgatcgggaaaccccggtccaacccgt

SEQ ID NO: 529367 - DNA, 516 bp, Homo sapiens
  misc_feature: HEFZJCU01A0JV9.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaacctcactgactttgcaaatgaacaccctgcgagccgaggacacggccgtatattactgtgcgagaactaaccgttcgcctggtta

SEQ ID NO: 529368 - DNA, 534 bp, Homo sapiens
  misc_feature: HEFZJCU01DJYHR.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcagcctccaccaaggcccatcggtcttcccctggcaccctcctccaagagcacctctggggcacagcc

SEQ ID NO: 529369 - DNA, 522 bp, Homo sapiens
  misc_feature: HEFZJCU01EPBVU.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccagggggacaatggtcaccgtctcttcagt

SEQ ID NO: 529370 - DNA, 460 bp, Homo sapiens
  misc_feature: HEFZJCU01D5U4X.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacgacggctgtctattactgtgcgaggccccgagcgcagtggtc

SEQ ID NO: 529371 - DNA, 485 bp, Homo sapiens; identical to SEQ ID NO: 463023
  misc_feature: HEFZJCU01CFX6O.11.23.C01.1.454.heavy.3.raw

SEQ ID NO: 529372 - DNA, 507 bp, Homo sapiens; identical to SEQ ID NO: 492497
  misc_feature: HEFZJCU01DYZCK.17.25.C03.1.454.heavy.3.raw

SEQ ID NO: 529373 - DNA, 519 bp, Homo sapiens
  misc_feature: HEFZJCU01B9OR8.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctgggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattcccaagaacacactgtatctgcaaatgaacagcctgagagccgacgacacggcccatatattaactgtagcgtaaagccaccggcagttagtcacccatactacttttgactactggggccgg

SEQ ID NO: 529374 - DNA, 541 bp, Homo sapiens
  misc_feature: HEFZJCU01CXQLB.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacagggcggtttgtcttctccatggatacctctgtcgggacggcttatctgcagataaccaaccttcaacctgacgacactcgccgtttactttttgtacgagagtcgtcgtctgtcagtggaattgactacgtggggccgagggaaccctggtcaccgtctccctcagccctccaccaacggg

SEQ ID NO: 529375 - DNA, 527 bp, Homo sapiens
  misc_feature: HEFZJCU01C2VGP.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcagcctccaccaaggcccatcggtcttcccctggcaccctcctccagagcacctctggggc

SEQ ID NO: 529376 - DNA, 504 bp, Homo sapiens
  misc_feature: HEFZJCU01AWFSL.14.78.H01.1.454.heavy.3.raw
  modified_base (460)..(460): a, c, t, g, unknown or other
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactgggccagggaaccctggtcaccgtctcctttcagcctccaccaagggcccatcggtcttcccctggcaccctcctccaagagcacctctggggcncagcgcctgggctgcctggtcaaggactacttccgtactagacg

SEQ ID NO: 529377 - DNA, 508 bp, Homo sapiens
  misc_feature: HEFZJCU01C8G24.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacggtcccacgatccgggtgagcctacggcagcggcctttggacttcgtc

SEQ ID NO: 529378 - DNA, 520 bp, Homo sapiens
  misc_feature: HEFZJCU01B7PDZ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgttcagtcacacctacatgacgctgggtccgccaggctccagggaaggggctggagtgcgtctcttttatttatagtagtggtagtacatactccgcagactccgtgaggggccattcaccagtctccagagacaattccaagaacacgctgtttcttcaaatgaacagcctgagagccgatgacacggccgtgtattactgtgcgagagatggggcccacgacgttactacgctatggacgtctggggccaagggaccg

SEQ ID NO: 529379 - DNA, 394 bp, Homo sapiens
  misc_feature: HEFZJCU01DQ36X.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacaccggccctttattactgtgcgcgagggcccctatcgagtgactatgatcccaggccctttgactcctggggccagggaaccctggtcaccgtctcctcagcctccaccaagggcccatcggtcttcccctggcgccctgctccagagcacctccgagagcacagcggccctgggctgcctggtcaaggactacttccgagtagtaca

SEQ ID NO: 529380 - DNA, 486 bp, Homo sapiens
  misc_feature: HEFZJCU01APYZK.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcgaaggactacgttcccacctactatg

SEQ ID NO: 529381 - DNA, 510 bp, Homo sapiens
  misc_feature: HEFZJCU01EGTIY.12.11.A11.1.454.heavy.3.raw
  modified_base (498)..(498): a, c, t, g, unknown or other
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggaccaggctgtgtatttctgtgcgaggacgtcctacggtgacaaatttntacaaaccagac

SEQ ID NO: 529382 - DNA, 499 bp, Homo sapiens
  misc_feature: HEFZJCU01CS83K.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctacggcgggctgaccactggggccg

SEQ ID NO: 529383 - DNA, 510 bp, Homo sapiens
  misc_feature: HEFZJCU01BBTUO.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatggggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctcggcgccctgctccaggagcacctcgtcggggcgac

SEQ ID NO: 529384 - DNA, 533 bp, Homo sapiens
  misc_feature: HEFZJCU01EH4J4.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactaggccaactactatgggggcttgttctggggccaggggaccctggtcatccgtctccccagcctccaccaacgggcccatcggtccttccccctggccgcctcg

SEQ ID NO: 529385 - DNA, 520 bp, Homo sapiens
  misc_feature: HEFZJCU01EEME3.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggccgccctcgctccaggagcacctccgagagcacagcggcccgtcggcgtcg

SEQ ID NO: 529386 - DNA, 395 bp, Homo sapiens
  misc_feature: HEFZJCU01AQOKP.51.60.F05.1.454.heavy.3.raw
cgatcgtatacacgaccggtgctcgatttagtacgtcatcagggaaaggggctggagtggatcggagaaatccaccatagtggaaacaccaactacagcccgtccctcaagagtcgaatcaccttatcagtagacacggccaagaaccagttctccctgaggctgacttctgttaccgccgcggacacggctgtttattactgtgcgagagctttgccaagttcgtctcgttttgacccatactttgactcctggggccaaggaacgctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 529387 - DNA, 510 bp, Homo sapiens
  misc_feature: HEFZJCU01A1QPI.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggccccgagcgcagtggtcttttgtatgtcctttgatatggtggggccaagggacaagtgtcgaccgtt

SEQ ID NO: 529388 - DNA, 512 bp, Homo sapiens
  misc_feature: HEFZJCU01E11DU.10.44.D11.1.454.heavy.3.raw
catagtagtgcacgaccggtgctcgatttagcgcagtacgaaggggggggagaggagcccagcactagaagtcggcggtgtttccattcggtgatcagcactgaacacagaggactcaccatggagtttgggctgaactgggtttttcctcgttgctcttttaagaggtgtccagtgtcaagtgcaactggtggagtctggggggaggcgtggtccagcctggggaggtcacagagactctcctgtgcagcctctgggttcaccttcagtagctacggcatgcactgggtccgccaagctccaggcaagggattggagtggggtggcagttgtttcatctgagggcagtgttcaatggtatgcagactccgtgaagggccgattcaccatctccagagacaattccaggaacacaatgtatttggaaatagaacagcctaagtcctgaggacacaggtgtatactactgtacgaagggaggggggaaccgaggcgggagtccgaagtactcc

SEQ ID NO: 529389 - DNA, 531 bp, Homo sapiens
  misc_feature: HEFZJCU01EDA0M.8.34.D01.1.454.heavy.3.raw
ctcgcgtgtccacgaccggtgctcgatttagatcgtctgtgttggggtttgggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatagtatttggagctgaacagcctaagtcctgaggacacgggacgtagtactactgtacgaagggaggggggaaccaggcgggagtccaagtacctacctttgacgtcgtgggg

SEQ ID NO: 529390 - DNA, 500 bp, Homo sapiens
  misc_feature: HEFZJCU01E1JD7.53.26.C04.1.454.heavy.3.raw
cgcgtatacacacgaccggtgctcgatttagtctagcgactttgggtttggggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacgagggccatcagaacagcctacactggagctgaacagactgacatctgacgacacggccgtttattattgttgtgaggaggacgggaccgatgaccgtc

SEQ ID NO: 529391 - DNA, 524 bp, Homo sapiens
  misc_feature: HEFZJCU01B9IJ6.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggacaacgacctgagtggatgggatgggcgaaccctaacactggtgtcacagtgtcttcaccatcctccgggacagacttaccatgaccacgaactcctccaataaacacagcctacatggagttgagggagcctgacatctgacgacacgggccgtctattactgtgcggagacgtcccacgactccgggtgacgtccctacggctaaggccgggtccttttagaccttcgtcc

SEQ ID NO: 529392 - DNA, 506 bp, Homo sapiens
  misc_feature: HEFZJCU01EKWMN.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccacaaacacagcctacatggagttgaggagcctggcatctgacgacacggccgtctattactgtgcgagagtcccacgatccggtgagcctacggcaggcggcctttggacttcgtc

SEQ ID NO: 529393 - DNA, 514 bp, Homo sapiens
  misc_feature: HEFZJCU01CXWA5.10.38.D05.1.454.heavy.3.raw
  modified_base (381)..(381): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgcaggctccagggaaggggctggagtgggtctcagttattgaaacagatggcactacatattatctgactccgtgaagggccgttnaccctctccagagacacttccaacaacatcttgtatcttcacatgcacaatctgagagtcgacgacacggccacctattatttgtgccgcgaccattagactacgctcaatttctgggggtcccaggggaccg

SEQ ID NO: 529394 - DNA, 508 bp, Homo sapiens
  misc_feature: HEFZJCU01CPTC5.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggccccatcggtcttccccctggcaccctcctccaagagcacctctgggggcacagcggccctgggctgcctggtcaaggactacttccgagtagtaca

SEQ ID NO: 529395 - DNA, 505 bp, Homo sapiens
  misc_feature: HEFZJCU01EY9P7.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaagggctggagtgggttggcaacataaatccagatggaagtcagaaaacctatgtggactctctgaaggccgattcaccatctccagagacaacgccaagaactctctgtttctgcaaatggacagcctgagagtcgaagacaacggctgtgtattactgtgtgtctctgacgcctcggcccgacttggcttcg

SEQ ID NO: 529396 - DNA, 517 bp, Homo sapiens
  misc_feature: HEFZJCU01EDWXE.48.37.D04.1.454.heavy.3.raw
agtatacatacacgaccggtgctcgatttagtagcatactgttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactgccgtgttttattgtgcgagatccaggcgaggaggataccgattcttatatagcgactactactacttcggaatggtacg

SEQ ID NO: 529397 - DNA, 515 bp, Homo sapiens
  misc_feature: HEFZJCU01B4IFV.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctattttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaggggctggagtgggtctcagttattgaaacagatggcactacatattattctgactccgtgaagggccggttcaccctctccagagacacttccaacaacatcttgtatcttcacatgcacaatctgagagtcgacgacacggccaccttattattgtgcgcggaccatagacgtacgcctcaatttctgggggccaggggaccg

SEQ ID NO: 529398 - DNA, 537 bp, Homo sapiens
  misc_feature: HEFZJCU01CRJFI.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgtgaagatacgaagtctatgatacccaatttgggaggggccgtttcatgtctggggccaagggacgctggtcaccgtctctcagcctccaccaagggcccatcggtcttcccctggcaccctcctccagacgcacctctgggggcacgacgcc

SEQ ID NO: 529399 - DNA, 522 bp, Homo sapiens
  misc_feature: HEFZJCU01DRQFJ.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgtctggggccaggggaccctggtcatcgtctccccagcctccaccaacgggcccatcggtcttccccctggccg

SEQ ID NO: 529400 - DNA, 558 bp, Homo sapiens
  misc_feature: HEFZJCU01CF17D.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtggtattactgtgcggagattggtggtaaaaagtaaagtgggtctggttgttttagttttggggggccgagggggagccccgtggtaccaccggtt

SEQ ID NO: 529401 - DNA, 510 bp, Homo sapiens
  misc_feature: HEFZJCU01DFP21.12.2.A02.1.454.heavy.3.raw
  modified_base (404)..(404): a, c, t, g, unknown or other
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacactatccacgagcacagcctacatgganctgaggagcctgagatctgacgacacgggccgtgtattactggtgcgagtaggttttagtgattacttattgtacggtgggtaggtaccctggtcttacgtttttc

SEQ ID NO: 529402 - DNA, 522 bp, Homo sapiens
  misc_feature: HEFZJCU01AS6FD.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggttagtactatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccagggaccg

SEQ ID NO: 529403 - DNA, 541 bp, Homo sapiens
  misc_feature: HEFZJCU01D85U2.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcacttatttatagtggtggtaccacatactacacagactccgtgaagggccgattcaccatctcagaagacaattccaggaacacattgtatcttcaaatgaaataacctgagagccgaggacacggccatgtattacgtgtgtgggggctatttacttgaccccgtgggggcccgggggaacccgtgggtccaccgtcctccccacccctccaacccg

SEQ ID NO: 529404 - DNA, 496 bp, Homo sapiens
  misc_feature: HEFZJCU01BAG8S.51.38.D05.1.454.heavy.3.raw
cgatcgtatacacgaccggtgctcgatttagtatctgatagttgggtttgggggggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagactgacgacacggctctttttactgtgcgccaggaagcagtggctggccacta

SEQ ID NO: 529405 - DNA, 527 bp, Homo sapiens
  misc_feature: HEFZJCU01AI8A8.51.85.H08.1.454.heavy.3.raw
cgatcgtatacacgaccggtgctcgatttagtatcactcagtcgcgggtcggggggaggcgtggtccagcctggggggtccctgagagtctcgtgtgcagcctctggattcacctttcaggcgttacggcatgaactgggtccgccaggctccaggcaaggggctggagtgggtggctgtcataacatttgatggaactaagaaatattatgcagactccgtgaagggccgattcaccatctccagagacaattcaaaggacaccctatatttagaaatgagcagcctgagacctgcggacacggctgtgtattactgtgcgaaagatgggggaagttatttctatgatagtgttgggcgttactactcgaacgagtttgactactggggccagggagccctggtcaccgtctcctcagcctccaccaagggcccatcggtcttccccctggcaccctcctccaagagcaccctctgggggcacagcggccctgggctgtctggtcaaggactacttcctcgtagca

SEQ ID NO: 529406 - DNA, 501 bp, Homo sapiens
  misc_feature: HEFZJCU01E1JIK.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacatgaccaatatggaccctgtggacacagccacatattaactgttcacgctctatggttcggggagttattagtccctactttgactactgggccagggaactctggtcacgtcctccgcagcctcc

SEQ ID NO: 529407 - DNA, 523 bp, Homo sapiens
  misc_feature: HEFZJCU01BSWIQ.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttaatctagtgcgagagtattcgagtggttcgggacctcacctggttctacttcgatctctggggcctc

SEQ ID NO: 529408 - DNA, 495 bp, Homo sapiens
  misc_feature: HEFZJCU01CFLCK.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacgacggctgtgttattactgtgggagagatgggaggtcgatattgt

SEQ ID NO: 529409 - DNA, 404 bp, Homo sapiens
  misc_feature: HEFZJCU01B3AHD.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgaggagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 529410 - DNA, 512 bp, Homo sapiens
  misc_feature: HEFZJCU01A1QZK.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgagttcaccacttccagagacaacatcaagaactcaatgtatctccaaatgagcagcctgacatccgaggacacggccgtgtattactgtgcgagagttctttgggatgttgtcgttgcacacg

SEQ ID NO: 529411 - DNA, 503 bp, Homo sapiens
  misc_feature: HEFZJCU01D4JQS.40.35.D02.1.454.heavy.3.raw
  modified_base (478)..(478): a, c, t, g, unknown or other
tctagcgactcacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccggagcgcagtggctttttgatgcctttgatangtgggcacggggacaatggtcacgt

SEQ ID NO: 529412 - DNA, 351 bp, Homo sapiens
  misc_feature: HEFZJCU01DCPQZ.49.19.B08.1.454.heavy.3.raw
agtcgagagacacgaccggtgctcgatttagtgagtcagtaaggggactccgtgaagggccgatgcaccatctccagagacaactcgaaggacactttatatctgcaactcaacagactgacaaccgcggacgcggccgtctattactgtgtgaaagaagacggaccgctggacgaggagccagaggaaaatcactactttgactactggggccagggaagactggtcaccgtctcctccgcctccaccaagggcccatcggtccttccccctggcaccctcctccaagagcacctctgggggcacagcggccctgggctgcctggtcaaggactacttcctctctcgact

SEQ ID NO: 529413 - DNA, 479 bp, Homo sapiens; identical to SEQ ID NO: 449486
  misc_feature: HEFZJCU01EI0LC.26.78.H01.1.454.heavy.3.raw

SEQ ID NO: 529414 - DNA, 523 bp, Homo sapiens
  misc_feature: HEFZJCU01EN55Q.51.26.C04.1.454.heavy.3.raw
cgatcgtatacacgaccggtgctcgatttagtctagcgactttgggtttggggtctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacgagggcttgtttattactgtgtgcgatcccgacctcactgggtacggggaggttacttcctccgcaacggtatac

SEQ ID NO: 529415 - DNA, 525 bp, Homo sapiens
  misc_feature: HEFZJCU01AYJ4O.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggccgtggagtggattgggaacatctattacagcgggagcaccaactacaacccgtccctcaagagtcgagttaccatttcattaaacacgtctaagaaccagttctccctgaagctgacctttgtgactggccgcggacacggccgtgtatttactgtgcgagagacccctccgatagcagtggctggtccactaggtttgactacgtggggccagggaagcttggtcaccggtctcctcagcct

SEQ ID NO: 529416 - DNA, 508 bp, Homo sapiens
  misc_feature: HEFZJCU01A8IJE.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggctttcg

SEQ ID NO: 529417 - DNA, 503 bp, Homo sapiens
  misc_feature: HEFZJCU01A2NLH.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgcccgtgaccccctgactgataaaccggactggttcgaccccgtgggccgagggaaccctggtccaccgtctcctcc

SEQ ID NO: 529418 - DNA, 523 bp, Homo sapiens
  misc_feature: HEFZJCU01BNDNU.17.33.C11.1.454.heavy.3.raw
  modified_base (364)..(364): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctcccacaaaccnggtcggtccttacaatgaccaatatggaccctgtggacacagccacatattactgttcacgctctatggttcggggattattagtcccttactttgactacgtggggccagggaactctggtcaccgtctccgcagcctccaccaagggccccagttcc

SEQ ID NO: 529419 - DNA, 518 bp, Homo sapiens
  misc_feature: HEFZJCU01CQMJ7.48.59.F04.1.454.heavy.3.raw
agtatacatacacgaccggtgctcgatttagtacacacacttagggattggggcagggtgtacacctgtggttctcggggctgccctttggctttggagatggttttctcgatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggacggggctggaggtggattggggagtatttaccacagtgggagcacctactacaacccgtccctacaaaacgtcgaaggccaccatatccgtagacacgtccaagaaccaattctccctgaagctgagctctgtgacccgccgcagacacgggcctgtctattactgtgtcgacggccccg

SEQ ID NO: 529420 - DNA, 502 bp, Homo sapiens
  misc_feature: HEFZJCU01ETPNA.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctggaggacacggctggtgtattactgtgcgaaagatttctatagaggtgacgtac

SEQ ID NO: 529421 - DNA, 523 bp, Homo sapiens
  misc_feature: HEFZJCU01DHYME.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaaggcccatcggtcttccccctggccgccctgctccaggagcacctctgggggcacgagccggccgtcgggcgtggcctggtcgaaggactacttcccctataccg

SEQ ID NO: 529422 - DNA, 397 bp, Homo sapiens
  misc_feature: HEFZJCU01BQ0YF.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacaccggccctttattactgtgcgcgagggcccctatcgagtgactatgatcccaggccctttgactcctgggccagggaacccctggtcaccgtctcctcagcctccaccaagggcccatcggtcttccccctggcgccctgctccaggagcacctccgagaggcacagcggccctgggctgcctggtcaaggactacttccgagtagtaca

SEQ ID NO: 529423 - DNA, 484 bp, Homo sapiens
  misc_feature: HEFZJCU01DDRCA.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatacaacgtagacacatcgaagaaccagttctccctgcagctgacctctgtgactcccgaggacacgggtgtatattactgtggaagaggaccccatacg

SEQ ID NO: 529424 - DNA, 513 bp, Homo sapiens; identical to SEQ ID NO: 516972
  misc_feature: HEFZJCU01D1Y3R.7.28.C06.1.454.heavy.3.raw

SEQ ID NO: 529425 - DNA, 495 bp, Homo sapiens
  misc_feature: HEFZJCU01AVJKI.14.25.C03.1.454.heavy.3.raw
  modified_base (464)..(464): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcacgtgggtccgccaggctccaggcgaggggctggagtgggtggcgattatatcacatgatggaactaatagacgctatgccgactccgtgaagggccgattcaccatctccagagacaattccaagaacacgcagtactctgcaaatgaacagcctgagagctgacggacacggctgtgtnttactgtgggagagatggaggtcgatattgt

SEQ ID NO: 529426 - DNA, 526 bp, Homo sapiens
  misc_feature: HEFZJCU01ELP59.3.17.B06.1.454.heavy.3.raw
  modified_base (405)..(405): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagngatgattcagagaactcactttatctgcaaatgtaacagcctgagaaccgacgacaccggccgtctattattcgtgtacatagaccttaggattaccaacgacggtcggtacctgtattcc

SEQ ID NO: 529427 - DNA, 511 bp, Homo sapiens
  misc_feature: HEFZJCU01BYAH7.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctaacatggagttgaggagcctgacatctgacgacacggcccgtctattactagtgcgagagtcccaacgatccggtgagcctacgggcaggcggcctttgactttcgtc

SEQ ID NO: 529428 - DNA, 502 bp, Homo sapiens
  misc_feature: HEFZJCU01CNKD2.14.25.C03.1.454.heavy.3.raw
  modified_base (470)..(470): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccgaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtgttatttacnggttgggaagagatgggaggtcgatatttgta

SEQ ID NO: 529429 - DNA, 495 bp, Homo sapiens
  misc_feature: HEFZJCU01C6027.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcacctttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgtaaatttgaggacacgggccactttattactgtgcaaggacagcatatgactcgtccccgactt

SEQ ID NO: 529430 - DNA, 524 bp, Homo sapiens
  misc_feature: HEFZJCU01DKFCD.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattaattgtacattaggacgactatagtcccgtggggccgagggaacccgtcgtccaccgtcctcctccagcctccacccaaggccccatcggtcgttcccccttcggccgccccg

SEQ ID NO: 529431 - DNA, 509 bp, Homo sapiens
  misc_feature: HEFZJCU01D3DFV.11.40.D07.1.454.heavy.3.raw
cgagagataccacgaccggtgctcgatttagtgatagagcgtaacaacagaggactcaccatggagtttgggctgacctgggttttcctcgttgctcttttaagaggtgtccagtgtcaggtgcagctggtggagtctggggggaggcgtggtccagcctgggaggtccctgagactctcctgtgcagcctctggattcatcttcaatacctttggcatgcactgggtccgccaggctccaggcaaagggctggagtggctatcatttatgtcatttgatggaactaatatatactattctggggccgttaagggtcgattcaccatctccagagacaattccaggaacacgctgtatctgcaattacacagcccgacaactgacgacacggctgtttattactgtgccacagatatacgcgaatttagcaggggtggccagtacagtcatacatttgccaactcggggccagggaaccctggtcatcgtctcctcagccctccacccg

SEQ ID NO: 529432 - DNA, 523 bp, Homo sapiens
  misc_feature: HEFZJCU01DCN1N.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccattcaccatctccagagacaattccaagaacacgctgtttctcaaatgaacagcctgagagccgatgacacggcccgtgtacttatgttgcgtagagagtggggcccacgaacgttactacgctagtggacgtctgggggccaaggggaccg

SEQ ID NO: 529433 - DNA, 535 bp, Homo sapiens
  misc_feature: HEFZJCU01B75YU.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtcgtggggccgaagggaccacgggtcatcgtctcctcagtcctcctaccgaacggggccccagtccgggtcctttcccccgtcggaccgacccc

SEQ ID NO: 529434 - DNA, 521 bp, Homo sapiens
  misc_feature: HEFZJCU01EIZRK.47.55.E11.1.454.heavy.3.raw
  modified_base (431)..(431): a, c, t, g, unknown or other
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaatgaacaatcngagagtcgacgatacggctgtctatcattgttgttttcgatgtccttcggtcccggcgggtaccttctgggggccaggggtaaccccttc

SEQ ID NO: 529435 - DNA, 501 bp, Homo sapiens; identical to SEQ ID NO: 490415
  misc_feature: HEFZJCU01AF643.11.27.C05.1.454.heavy.3.raw

SEQ ID NO: 529436 - DNA, 531 bp, Homo sapiens
  misc_feature: HEFZJCU01BNNII.18.14.B03.1.454.heavy.3.raw
tacgagtatgcacgaccggtgctcgatttagtgtgagtagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattactggggccagggaaccctaagtcaccgtcgccgcagcctccaccaagggcccatcggtcttcccctggccgccctgctccaggacgccacctccgacgaccggcccgtcgggctcgcctc

SEQ ID NO: 529437 - DNA, 523 bp, Homo sapiens
  misc_feature: HEFZJCU01DV0K4.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagaccttaccatgaccacgaactcctccataaacacagcctacatggagttgaggagcctgacatctgacgacacggccgtctattactgtgcgagacgtcccacgattcccgggttgacggccctaaccggcaggccgggccttttggacctttcgtc

SEQ ID NO: 529438 - DNA, 496 bp, Homo sapiens
  misc_feature: HEFZJCU01C1SBM.48.31.C09.1.454.heavy.3.raw
  modified_base (451)..(451): a, c, t, g, unknown or other
  modified_base (487)..(487): a, c, t, g, unknown or other
agtatacatacacgaccggtgctcgatttagacgtctcatcaaggaaggaaggggtctgagagaggagccttagccctggattccaaggcctatccacttggtgatcagcactgagcaccgaggattcaccatggaactggggctccgctgggttttccttgttgctattttagaaggtgtccagtgtgaagtacagctggtggagtctgggggaggcctggtcaagcctggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatgacaacctgagaggngaggacacggctgtatattactgtgtctcccatacntcgcagctc

SEQ ID NO: 529439 - DNA, 508 bp, Homo sapiens
  misc_feature: HEFZJCU01AV343.49.61.F06.1.454.heavy.3.raw
agtcgagagacacgaccggtgctcgatttagctacgctctaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttcccctggcaccctcctccaagagcacctctgggggcacagcggccctgggctgcctggtcaaggactacttcctctctcgact

SEQ ID NO: 529440 - DNA, 504 bp, Homo sapiens
  misc_feature: HEFZJCU01C1EZX.4.81.H04.1.454.heavy.3.raw
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcgacctggtggagtctgggggaggcctggtcaaaccgtggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgagggccgattcaccatctccagagacaacgccaagaactcagtgtttctgcaaatgaacagcctgagagtcgaggactcggctgtctactactgtgcgagaataaggagctacctacgatttggacac

SEQ ID NO: 529441 - DNA, 523 bp, Homo sapiens
  misc_feature: HEFZJCU01B4Y94.2.81.H04.1.454.heavy.3.raw
  modified_base (505)..(505): a, c, t, g, unknown or other
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggaggtccggggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggntgtgtattattgtgcgag

SEQ ID NO: 529442 - DNA, 523 bp, Homo sapiens
  misc_feature: HEFZJCU01C7J57.52.53.E09.1.454.heavy.3.raw
cgcagtacgacacgaccggtgctcgatttagagagagtgtgttgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacagggctgaggtggatggggtggaacaatcccaacagtggaggcaccggtcgcacagaatatgcgcggaagtttcgagggcagggtcaccgatgaccagcgacaggtccactaacacagcctacatggagctaagtagactgacatctgacgacacggccgtctattattgtgtgagagaggacccgtatcggacctcggaaacatgggacgttctgggggtacc

SEQ ID NO: 529443 - DNA, 543 bp, Homo sapiens
  misc_feature: HEFZJCU01AVQ8G.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggtcgttgttcgttgggggccgacgggggaccccgttgggtctatcggttcctccccacgcccttccacccgaacggggacccagtccggtcttccccc

SEQ ID NO: 529444 - DNA, 517 bp, Homo sapiens
  misc_feature: HEFZJCU01DU6NA.51.40.D07.1.454.heavy.3.raw
cgatcgtatacacgaccggtgctcgatttagtgatagagcgtaacaacagagggggggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctaggaggacacggctgtttattactgtgcgaacttaatcacggagacaaccggtaaccccgtccgaccg

SEQ ID NO: 529445 - DNA, 494 bp, Homo sapiens
  misc_feature: HEFZJCU01BWC6J.16.37.D04.1.454.heavy.3.raw
  modified_base (461)..(461): a, c, t, g, unknown or other
  modified_base (469)..(469): a, c, t, g, unknown or other
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaaagaacacgctgtatttgcaaatgaacagtctgagagtcgaggacacgggccatatattactgtgcgaagcgggaattggtggcggtgactgctattgactactggggccagggaaccctggtcaccgtctcctcagcctcccaccaagggcccatcggtcttcccctggcaccctcctccaagagcacctctggggcacagcggccnggctgccnggtcaaggctactccgagtagtaca

SEQ ID NO: 529446 - DNA, 505 bp, Homo sapiens
  misc_feature: HEFZJCU01CU1L5.11.71.G05.1.454.heavy.3.raw
cgagagataccacgaccggtgctcgatttagtgtcgtcgcaagagagaggggggggaggaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtatttactgtgacggaaagtatttcgtatagaggtgacgtac

SEQ ID NO: 529447 - DNA, 496 bp, Homo sapiens
  misc_feature: HEFZJCU01DSUJF.10.21.B10.1.454.heavy.3.raw
  modified_base (483)..(483): a, c, t, g, unknown or other
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccgacctggggggtccctgagactctcctgttctgcgtctggattcatctttagtaaatctggcatgtcctgggtccgccaggttccaggccacgggctggaatgggtggcagatatacaatatgatgacagtaaaatataactatggagactccttcaagggccgattcaccatcctccagagacaattccaagaacataggtgtatctgcaaatgaccagccagagagccgaggacacgggtgtttattctgtggganaaatcctagtggc

SEQ ID NO: 529448 - DNA, 318 bp, Homo sapiens
  misc_feature: HEFZJCU01ES06Q.13.17.B06.1.454.heavy.3.raw
tcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacatttttgtagaggtgtactggggccagggagccccggtcaccgtctcctcagcctccaccaagggcccatcggtcttccccctggcgccctgctccaggagcgacctccgacgagcacagcggccctgggctgcctggtcaaggactacttcctagtacgtga

SEQ ID NO: 529449 - DNA, 502 bp, Homo sapiens
  misc_feature: HEFZJCU01BLXAR.53.4.A04.1.454.heavy.3.raw
cgcgtatacacacgaccggtgctcgatttagagtagtgatcagggggctctgggagacgagcccagcactggaagtcgccggtgtttccattcggtgatcatcactgaacacagaggactcaccatggagtttgggctgagctgggttttcctcgttgctgttttaagaggtgtccagtgtcaggtgcatctggtggagtctgggggaggcgtggtccagcctggggggtccctgagactctcctgtgcagcctctggattcaccttcagtacctatcctattcactgggtccgccaggctccaggcaagggcctggagtgggtggcacttatatcatatgatggaggtgataaatactacgcagactccgtgaagggccgattcgccatctccagagacaattccaagaacaccctctatctacaaatgaagagactgagacctgaggacacggctgtctattactgtgtcgagagtcggctttagagatgcctacaaacg

SEQ ID NO: 529450 - DNA, 370 bp, Homo sapiens
  misc_feature: HEFZJCU01DSEK2.3.42.D09.1.454.heavy.3.raw
agacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggctacttccgagtgcgtct

SEQ ID NO: 529451 - DNA, 399 bp, Homo sapiens
  misc_feature: HEFZJCU01B46Z5.40.81.H04.1.454.heavy.3.raw
tctagcgactcacgaccggtgctcgatttagtagtgtagattcgcggggaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcaggcagggtcaccatgacctgggacgcgtccatcagcacagtctacatggat

SEQ ID NO: 529452 - DNA, 505 bp, Homo sapiens
  misc_feature: HEFZJCU01EU0G1.40.1.A01.1.454.heavy.3.raw
tctagcgactcacgaccggtgctcgatttagacgtctcatcagggggctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcattttcagtaactatgctatgcactgggtccgccagactccgggcgaaggggctgggagtgggtggcaattatctcatatgatgaaagtcaagaatactacgcagactccgtgaagggccgagttcaccatctccagagacaattccaagaacacactgaatctacaaatgaacagcctcagacctgaggacgtcggctgtctatttcgtgttgcgaggagggggtgacgtactacgacttcc

SEQ ID NO: 529453 - DNA, 490 bp, Homo sapiens
  misc_feature: HEFZJCU01CDSOO.49.17.B06.1.454.heavy.3.raw
agtcgagagacacgaccggtgctcgatttagtcgatagtgaaggggctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggagcgtggtccagcctgggagtccctgagactcgcctgcaaaccgtccggattcaccttcagtaattatgcaatgcactggtccgccagactccaggcaaggggctgcactgggtggcggccatatcatttgatggaagcaagaatactatgcagactccgtgacggggccgattcaccatcctccagagacagttccgatgacacagtgtatctgcaaatgaacagcctgagacctgaggacacggctctcttttactgtgcgccaggaagccagtcggctggccg

SEQ ID NO: 529454 - DNA, 528 bp, Homo sapiens
  misc_feature: HEFZJCU01C92YO.49.59.F04.1.454.heavy.3.raw
agtcgagagacacgaccggtgctcgatttagtacacacacttagggattggggacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggccctggacaagggcttgagtggatggggaggatcatccctattgttggtgtgacaaactacgcacagaagttccaggacaggaatcacgataaccgcggacacatccacgagcactattttcatggaactgagcagcctcagatccgaggacacggccgtttactactgtgcgagcgatcccggacttcccgtcgtttcgagggactggactactcgggggccacggggaaccctcggtctaccg

SEQ ID NO: 529455 - DNA, 527 bp, Homo sapiens
  misc_feature: HEFZJCU01BJ8TQ.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcaccgtgaaaggcagattcaccatctccagagatgattcaaataaatatgtcatatctacaaatggatagcctgaaaatcgaggatacaggttgtttataccttggttcccacgagggaatggcgtttctctgggggccgaggggacct

SEQ ID NO: 529456 - DNA, 489 bp, Homo sapiens
  misc_feature: HEFZJCU01DEC3P.19.71.G05.1.454.heavy.3.raw
  modified_base (435)..(435): a, c, t, g, unknown or other
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatattcatgtccaacacgtggaatacaaattatgcaccatctgttgagagtcgactgacaatcaacgtagacacatcgaagaaccagttcgtccctgcagctgacctctgtgactcccgaggacgacgggtgtatnttactgtggaagaggcccccatacgactatgccacctcgtctcgttggtgtact

SEQ ID NO: 529457 - DNA, 505 bp, Homo sapiens
  misc_feature: HEFZJCU01ETAK8.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctgggagtgggtctcagttattgaaaacagatggcactacatattattctgactccgtgaagggccggttcaccctctccagagacacttccaacaacatcttgtatcttcacatgcacaatctgagagtcgcgacacggaccacctattattgtgcgcgacatgactagctcattctggggccagggacg

SEQ ID NO: 529458 - DNA, 546 bp, Homo sapiens
  misc_feature: HEFZJCU01AWJSW.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgttgttttagttgggggccaggggacgccccgtggtcctaccg

SEQ ID NO: 529459 - DNA, 510 bp, Homo sapiens
  misc_feature: HEFZJCU01A5FJV.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctgggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtggggcccggggagcccgt

SEQ ID NO: 529460 - DNA, 497 bp, Homo sapiens
  misc_feature: HEFZJCU01BMN3Y.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattcccaggacagagtcacgattaccgcggacgaatccacgaccacagcctacatagagctgcgcagcctgagatctgaagacacggccatttattactgtgcgagagatgcagggccctcccacatcggtttatttcgtttgacctcctggggtccagggaaccctggtcaccgtctcctcg

SEQ ID NO: 529461 - DNA, 491 bp, Homo sapiens
  misc_feature: HEFZJCU01ED0AP.49.9.A09.1.454.heavy.3.raw
agtcgagagacacgaccggtgctcgatttagcgagacgcgcaggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagccgtggggggtccctaagactctcctgtgcagcctctggaatcgccttcaataagttttggatgtactgggtccgccaagttccagggaaggggctgatggtgggtctcacgtattgatgttgaagtggggagtttacagtgaaccacggccggactctgtgaacgggccgattcaccgtctccagaagaaaacggcaagaacacggtgtatctgacaatgactggcctgagaggccgaggacacggcagtttattactgtgacaagaggcgttgtggtcgac

SEQ ID NO: 529462 - DNA, 502 bp, Homo sapiens
  misc_feature: HEFZJCU01DS88V.8.34.D01.1.454.heavy.3.raw
ctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtaatttggagctgaacagacctaagtcctgagacacggcgtatactactgtacgaggaggggggaacgagcgggagtccaagtct

SEQ ID NO: 529463 - DNA, 500 bp, Homo sapiens
  misc_feature: HEFZJCU01ALJBV.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggtttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccgagggaaggggctgggaatggatgacagttatttcacacgatgcaaccaaaacatactacgcggagttcgtgaggggccgcgtgcatcgtctccagagacaattcgaagaacactctgtacctgacaaatagaacagtctgagagccgaggacacggccgtctacttttgtgcgactagaagtgggagcta

SEQ ID NO: 529464 - DNA, 506 bp, Homo sapiens
  misc_feature: HEFZJCU01DQPYL.11.27.C05.1.454.heavy.3.raw
cgagagataccacgaccggtgctcgatttagacgcgatcgaagggtttgggggagagaggatccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaaggggccgactcaccatcctccagagacaacgccaagaactcactgtatctgcaaatgaacagcctgagagccgaggacacggctgtgtattactgtgcgagaggagctattatctggaaccccgatgttc

SEQ ID NO: 529465 - DNA, 531 bp, Homo sapiens
  misc_feature: HEFZJCU01DK7FA.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacgagccgtgtattactgtaccacatcccctgaagcgtcaactactactactacggtatggacctcg

SEQ ID NO: 529466 - DNA, 510 bp, Homo sapiens
  misc_feature: HEFZJCU01C2P0H.10.28.C06.1.454.heavy.3.raw
  modified_base (417)..(417): a, c, t, g, unknown or other
  modified_base (439)..(439): a, c, t, g, unknown or other
catagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtggaggggccgagttcaccatctccagngaacaatgccaggaattcactntatgtggaaatgaacagtctgagagccgaggacacggctactctattactgtgcgagagaccccgaaatac

SEQ ID NO: 529467 - DNA, 506 bp, Homo sapiens
  misc_feature: HEFZJCU01EDDZ0.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagaggtcgacgatacggctgtctatcattgtgttttcgatgccttcggtccgcgggacttcgtgggccac

SEQ ID NO: 529468 - DNA, 511 bp, Homo sapiens
  misc_feature: HEFZJCU01AJGO4.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggactactgtcaccgtctccgcacgcctccaccaaggccc

SEQ ID NO: 529469 - DNA, 506 bp, Homo sapiens
  misc_feature: HEFZJCU01BSC8O.11.19.B08.1.454.heavy.3.raw
  modified_base (421)..(421): a, c, t, g, unknown or other
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattccaccatctccagagacaacgccaggaactcactttatcngcaaatgagcagcctgagagttcgaggacacgggtaatttattactgtgcgagagatagtctggtctatgcttccgggagcctaa

SEQ ID NO: 529470 - DNA, 512 bp, Homo sapiens
  misc_feature: HEFZJCU01EPWZE.8.34.D01.1.454.heavy.3.raw
  modified_base (46)..(46): a, c, t, g, unknown or other
ctcgcgtgtccacgaccggtgctcgatttagatcgtctgtgttganctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaaggccgattcaccatctccagagacaattccaggaacacaatgtatttggagctgaacagcctaagtcctgaggacgacgggcgtatactactgtacgaagggaggggggaaccaggacgggagttccaatactccttt

SEQ ID NO: 529471 - DNA, 499 bp, Homo sapiens
  misc_feature: HEFZJCU01C5N84.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaattatgatgacagtaaaatatactatggagactccttcaagggccgattcaccatctcagagacaattccaagaacatggtgtatctgcaaatgaccagcctgagagccggaggacacggggttgttttattacgtgtgggagaaatcctagtgg

SEQ ID NO: 529472 - DNA, 533 bp, Homo sapiens
  misc_feature: HEFZJCU01BZX7Z.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaattaacgaacacagtaatctggagctgaacagctgtcatctgaggacacggcttctacttctgtgcgaggagtaattactataacactgcttcctttttactacccttcccttgtacttctggggtccatcggaaccccggtccg

SEQ ID NO: 529473 - DNA, 503 bp, Homo sapiens
  misc_feature: HEFZJCU01D95K7.17.10.A10.1.454.heavy.3.raw
  modified_base (461)..(461): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctntcatcgtacaatttgataggctctatggactggactttcgtc

SEQ ID NO: 529474 - DNA, 497 bp, Homo sapiens
  misc_feature: HEFZJCU01ASD58.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacactcgacgacacggcatgtattactgtggagtagacgttggtgctacgcgggctgaccacgtgggaccg

SEQ ID NO: 529475 - DNA, 526 bp, Homo sapiens
  misc_feature: HEFZJCU01CUXZI.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctagcacccgtgaaaggcagattcaccatctcaagagatgattacaaaagcaacgctgtatctgcaaatgaacagcctgagaaccgaggacacagccgtgtaattactgtaccacactccctgaaagcgtcaactactactactacggt

SEQ ID NO: 529476 - DNA, 572 bp, Homo sapiens
  misc_feature: HEFZJCU01DTCP9.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaaggacacggctgtgtattactgtgggagtccctggctggcacctgtatccgaccgttggagtcagggaactctggtcaccgtcctcctcagcctcccaccaaacgggcccacgtccggttccgtttccccccttcgggccgtcccctcgccgtccctacgggaacggcgacccgtaccccgacggaacggccaaccgaacggccggccccgttcggggcgttcc

SEQ ID NO: 529477 - DNA, 526 bp, Homo sapiens
  misc_feature: HEFZJCU01CE4RA.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaaagttccagggcagactcaccataaccgcggacaaattaacgaacacagttaatctggagctgaacagcctgtcatctgaggacacgggcttctacttctgtgcgagagtaattactataacatgctccttttacacctccttgacttcgtgggccatggaacccggtccg

SEQ ID NO: 529478 - DNA, 511 bp, Homo sapiens
  misc_feature: HEFZJCU01EETI4.51.1.A01.1.454.heavy.3.raw
cgatcgtatacacgaccggtgctcgatttagacgtctcatcaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagggtctatgacatgcactgggtccgccaggctccaggcaaggggctggagtggggtggcagtcatctggcctgatggaggtttaacatactatgcggactccgtggagggccgattcaccgtctccagagacaactccaaaaacacgctgtatctaccaaatgaacagcctcagatctgaggacacggctatctactactgtgtgaaaagtattgggtttcaggtggcttactttagacttcgtc

SEQ ID NO: 529479 - DNA, 503 bp, Homo sapiens
  misc_feature: HEFZJCU01A4PIM.26.37.D04.1.454.heavy.3.raw
agactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctcttatatcatatgatggaagtaatgaacattacgcagactccgtgaagggccgattcaccgtctccagagacaattccaagagcacgatgtttctgcaatgaacagcctgagagttgaggacacgggtgtctatttctgtgcgcgagtccgggtgaggggtgtccac

SEQ ID NO: 529480 - DNA, 524 bp, Homo sapiens
  misc_feature: HEFZJCU01DXP3N.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagcctacatggaactcaacggcctcagatttgaggacacggccgtctattattgtgcgagagtgagaaattacggtggctactcccttgactacgtggggccaggggaaccctggtctaccg

SEQ ID NO: 529481 - DNA, 536 bp, Homo sapiens
  misc_feature: HEFZJCU01B1188.17.28.C06.1.454.heavy.3.raw
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtataggctgtgtttatggggccaggganccctggtctaccg

SEQ ID NO: 529482 - DNA, 541 bp, Homo sapiens
  misc_feature: HEFZJCU01EEXZ7.53.78.H01.1.454.heavy.3.raw
cgcgtatacacacgaccggtgctcgatttagtgtgagtagtttgggtttgggctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccgagggaaccctgatcaccgtctcctcagcctccaccaacgggcccactcggtcttccccctcggccaccctccctccaacgagcacctctgggggcacagcggccctgggctgcctggtcaaggactactt

SEQ ID NO: 529483 - DNA, 501 bp, Homo sapiens
  misc_feature: HEFZJCU01BT2TQ.4.57.F02.1.454.heavy.3.raw
  modified_base (477)..(477): a, c, t, g, unknown or other
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtgggcagggaaccctggtcaccgtctcctcagcttccaccaaggcccatcggtcttcccctggcgcccngctccaggagcacctctggggcac

SEQ ID NO: 529484 - DNA, 508 bp, Homo sapiens
  misc_feature: HEFZJCU01CQ5H3.10.38.D05.1.454.heavy.3.raw
  modified_base (442)..(442): a, c, t, g, unknown or other
  modified_base (463)..(463): a, c, t, g, unknown or other
  modified_base (479)..(479): a, c, t, g, unknown or other
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattggaaacagatggcactacatattattctgactccgtgaagggccggttcaccctctccagagacacttccaacaacatcttgtatcttcacatgcacaatctganagtcgacgacacggccacctnttattgtgcgcgaacntgactacgctcattctggggccagggacg

SEQ ID NO: 529485 - DNA, 375 bp, Homo sapiens
  misc_feature: HEFZJCU01BQZBC.13.78.H01.1.454.heavy.3.raw
tcacgtactacacgaccggtgctcgatttagtgtgagtagtttgggtttggggaaatctatcatagtgggaccacctactacagcccgtccctcaatagtcgcgtcaccatgtaagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctggactgcctggtcaaggactacttcctagtacgtga

SEQ ID NO: 529486 - DNA, 506 bp, Homo sapiens; identical to SEQ ID NO: 446520
  misc_feature: HEFZJCU01EFKCD.10.38.D05.1.454.heavy.3.raw

SEQ ID NO: 529487 - DNA, 501 bp, Homo sapiens
  misc_feature: HEFZJCU01A2NTJ.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagttagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgagacacggctgtgtattactgtgcgagaggagctattatctcggaaccccgat

SEQ ID NO: 529488 - DNA, 389 bp, Homo sapiens; identical to SEQ ID NO: 457462
  misc_feature: HEFZJCU01BHUJS.51.49.E05.1.454.heavy.3.raw

SEQ ID NO: 529489 - DNA, 537 bp, Homo sapiens
  misc_feature: HEFZJCU01B3SG1.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttgggttatgtccaccacagagggatcccttactacaacccgtcactcaagagtcgacttaccatatcactcgacacgtccaggaatcagttctcctgaaactgacggtccgtcattgtcgcggacacagccgtctattattgtgtcagagatccggccataactggctcggccctgggggcccggaaccctggtcaccgtctcctcacgcctccaccgaagggcccagtcggtccttcccccgtggcctaccctcctcc

SEQ ID NO: 529490 - DNA, 496 bp, Homo sapiens
  misc_feature: HEFZJCU01A1D1C.47.55.E11.1.454.heavy.3.raw
  modified_base (440)..(440): a, c, t, g, unknown or other
agctcacgtacacgaccggtgctcgatttagcactcgcacgttgggtttgggggagccgcagccctgggattcccagctgtttctgcttgctgatcaggactgcacaacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactggtccgccaaactccaggtaaggggctggtgtgggtctcacgtatctaatcctgatggcagtgttataaattatgcggactccgtgaggggccgattcagcatctccagagacaacgggcaaggagtatactgtatctggaaatgaacaatctganagtcgacgatacggctgtctatcattgtgtttttcgattgcctttcggtccgcggg

SEQ ID NO: 529491 - DNA, 483 bp, Homo sapiens
  misc_feature: HEFZJCU01D8ZQV.49.32.C10.1.454.heavy.3.raw
agtcgagagacacgaccggtgctcgatttagtatagacatcaacacacaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatgtcatatgatggaagtaatatatactatatagactccgtgaagggccgattcatcatctccagagacaattccgagaacacgctgtatctgcaaatgaacagcctgagagttgaggacacggctgtgtattattgtgcgaactt

SEQ ID NO: 529492 - DNA, 525 bp, Homo sapiens
  misc_feature: HEFZJCU01B47K9.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctatatttgtgttcattagaacctaggactactaacgacggtgtacctggtaacttc

SEQ ID NO: 529493 - DNA, 504 bp, Homo sapiens; identical to SEQ ID NO: 445648
  misc_feature: HEFZJCU01DI891.17.25.C03.1.454.heavy.3.raw

SEQ ID NO: 529494 - DNA, 491 bp, Homo sapiens
  misc_feature: HEFZJCU01CUCFV.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccggtctcctcggcctccaccaagggcccatcggtcttccccctggcgccctgctccaggagcacctccgagagcacagcggccctgggctgcctggtcaaggactacttcccatactcgta

SEQ ID NO: 529495 - DNA, 505 bp, Homo sapiens; identical to SEQ ID NO: 445474
  misc_feature: HEFZJCU01ET8MG.16.34.D01.1.454.heavy.3.raw

SEQ ID NO: 529496 - DNA, 505 bp, Homo sapiens
  misc_feature: HEFZJCU01DL2MJ.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcaggagtcacgattaccgacggacacccccacgaacacagtctacatgcaactgacgagcctgagagctgacgacacggccgtctattactgtgcgagaattgttttctgtcatcgtacaatttgataggctctatggactggacttcgtc

SEQ ID NO: 529497 - DNA, 492 bp, Homo sapiens
  misc_feature: HEFZJCU01BYNDZ.49.4.A04.1.454.heavy.3.raw
agtcgagagacacgaccggtgctcgatttagagtagtgatcagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttagtctcatatgatggaagcaagatatactacattgactcgtgaagggccgattcatcatctccagagacaactccgagaacacactgtatcttcaatgaacaggttgagagctgaagacacggctttatatttactgtgacgaactttaatcgtaacggaa

SEQ ID NO: 529498 - DNA, 503 bp, Homo sapiens
  misc_feature: HEFZJCU01B6DMG.12.78.H01.1.454.heavy.3.raw
  modified_base (444)..(444): a, c, t, g, unknown or other
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaaggcccatcggtcttcccctgcaccctcctccanagcactctggggcacagcgcctgggctgcctggtcaaggactacttcctacgtcgtact

SEQ ID NO: 529499 - DNA, 507 bp, Homo sapiens
  misc_feature: HEFZJCU01ALHO9.17.10.A10.1.454.heavy.3.raw
  modified_base (444)..(444): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcgagcggctttgacggtaaggcacagtatgcaccgaagatgaagggcagagtcacgattaccacggacacccccacgaacacagtctacatgcaactgacgagcctgagagctgacgacacggccgtctattactntgtcgagaatgttttctgttcatcgtaactatttgattaggctctatggtactggacttcgtc

SEQ ID NO: 529500 - DNA, 401 bp, Homo sapiens; identical to SEQ ID NO: 450035
  misc_feature: HEFZJCU01B1TM0.47.24.C02.1.454.heavy.3.raw

SEQ ID NO: 529501 - DNA, 540 bp, Homo sapiens
  misc_feature: HEFZJCU01BR741.48.73.G07.1.454.heavy.3.raw
  modified_base (444)..(444): a, c, t, g, unknown or other
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggttggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcngtgggtctttttgtattcgtccttttcgtagttatggttagggggtccgtaaacggggaccgaaagtcggttacgacccggttccttcctttaccg

SEQ ID NO: 529502 - DNA, 534 bp, Homo sapiens
  misc_feature: HEFZJCU01D3CYO.40.20.B09.1.454.heavy.3.raw
tctagcgactcacgaccggtgctcgatttagtgtagtgtgaagggggagagaggagccttagcccgggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccggaactcctgtatctgcaatgaagagcctgcgagccgaggacacgggtgtttattattgtactaaaggacaaaggagggtactttgggagtactactacggtatggacgtcgtcggggccgaagggaccgccg

SEQ ID NO: 529503 - DNA, 378 bp, Homo sapiens; identical to SEQ ID NO: 460074
  misc_feature: HEFZJCU01AXXNU.47.77.G11.1.454.heavy.3.raw

SEQ ID NO: 529504 - DNA, 408 bp, Homo sapiens
  misc_feature: HEFZJCU01AHEEF.51.71.G05.1.454.heavy.3.raw
cgatcgtatacacgaccggtgctcgatttagtgtcgtcgcaagagagaggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggatcgtggggggggctggtccaggctgggaggtccctgagactctcctgtgcagcctctggattcaccttcacgtacccactggaaatgcacttcgggtccgaccgaggcttcccgaaggccaagggggtctgggagttgggtggccgagtttataagtcccttatgtatggaagccaaataacgcactacgcagagtccgtgta

SEQ ID NO: 529505 - DNA, 500 bp, Homo sapiens; identical to SEQ ID NO: 464137
  misc_feature: HEFZJCU01CEVH2.17.10.A10.1.454.heavy.3.raw

SEQ ID NO: 529506 - DNA, 519 bp, Homo sapiens
  misc_feature: HEFZJCU01C5BCH.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtcccaccaacacagcctacataggaactaaggggactggacatctgacgacacggccatgtattattgttgcgagagaaatgttaggtactgcgtttgggtcccgtcgggggtccccggggaacccgggtcg

SEQ ID NO: 529507 - DNA, 518 bp, Homo sapiens; identical to SEQ ID NO: 451751
  misc_feature: HEFZJCU01AV6DQ.9.34.D01.1.454.heavy.3.raw

SEQ ID NO: 529508 - DNA, 509 bp, Homo sapiens
  misc_feature: HEFZJCU01C1JY2.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccctggggccagggaaccctggtcaccgtctcctcagcctccaccaagggcccatcggtcttcccctggcgccctgctccaggacgcacctccgagagcacagcggccctgggctgcctggtcaaggactacttcctacgtcgtat

SEQ ID NO: 529509 - DNA, 521 bp, Homo sapiens
  misc_feature: HEFZJCU01B1Z3I.49.25.C03.1.454.heavy.3.raw
agtcgagagacacgaccggtgctcgatttagtagtgtagatttgggtttgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacgaagggtcgacccccgtccactcggtacggacg

SEQ ID NO: 529510 - DNA, 521 bp, Homo sapiens
  misc_feature: HEFZJCU01BPCCY.49.37.D04.1.454.heavy.3.raw
agtcgagagacacgaccggtgctcgatttagtagcatactgttgggtttgggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgagacacggctatgtattactgtgtgaaagtacttttatgacagtagtggtttctccgagtatgctacg

SEQ ID NO: 529511 - DNA, 376 bp, Homo sapiens
  misc_feature: HEFZJCU01AOYN8.47.77.G11.1.454.heavy.3.raw
  modified_base (372)..(372): a, c, t, g, unknown or other
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtgctacgactcttggggccgggaaccctggtcaccgtctcttcagcttccaccaagggcccatcggtcttccccctggcgccctgctccagagcacctctgggggcacagcggccctgggctgcctggtcaaggactacttcctacgtnagct

SEQ ID NO: 529512 - DNA, 314 bp, Homo sapiens; identical to SEQ ID NO: 444774
  misc_feature: HEFZJCU01CL38L.7.10.A10.1.454.heavy.3.raw

SEQ ID NO: 529513 - DNA, 514 bp, Homo sapiens
  misc_feature: HEFZJCU01DD05F.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccagggcccatcggtcttcccctggcaccctcctccagagcacctctgggggcacagcggccctgggctgcctggtcaaggactactccagcgtatca

SEQ ID NO: 529514 - DNA, 520 bp, Homo sapiens
  misc_feature: HEFZJCU01B3QWE.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggggtccctgagactctcctgtgcagcctctgggttcaccgtcagtcacacctacatgagctgggtccgccaggctccagggaaggggctgggagtgcgtctcttttatttatagtagtggtagtacatactccgcagactccgtgaggggccgattcaccatcctccagagacaattccaagaacacgctgtttcttcaaatgacagcctgagagccgatgacacggccgtgtattactgtgtcgagagatggggcccagaacgttactcgctatggacgtctggggccaagggaccg

SEQ ID NO: 529515 - DNA, 519 bp, Homo sapiens; identical to SEQ ID NO: 452709
  misc_feature: HEFZJCU01DIZ6A.3.82.H05.1.454.heavy.3.raw

SEQ ID NO: 529516 - DNA, 512 bp, Homo sapiens
  misc_feature: HEFZJCU01EPI06.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtcgtattactgtgcgagagtcccacgatccggtgagcctacggcagcggcctttgacttcgtggggcctaggggacg

SEQ ID NO: 529517 - DNA, 500 bp, Homo sapiens
  misc_feature: HEFZJCU01BY1KB.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgacaacgatgcttttgatatgtggggaccg

SEQ ID NO: 529518 - DNA, 524 bp, Homo sapiens
  misc_feature: HEFZJCU01EWL1J.48.67.G01.1.454.heavy.3.raw
agtatacatacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgaccgtctgtgaccgccgcagacacggctgtctattattgtgcgagactaggcttctgtagtggtggtacttgcaacccgggatactactccaacttcgcttggacatctggggccaagggacctc

SEQ ID NO: 529519 - DNA, 536 bp, Homo sapiens
  misc_feature: HEFZJCU01EIDUK.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccgagggaaaccgtggtcacccggtcctccccacgcttccaccaacgggcccactcggtcctttcccccg

SEQ ID NO: 529520 - DNA, 497 bp, Homo sapiens
  misc_feature: HEFZJCU01A9YH2.51.64.F09.1.454.heavy.3.raw
  modified_base (429)..(429): a, c, t, g, unknown or other
cgatcgtatacacgaccggtgctcgatttagcgcgtatacaaggggctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgancagcctgagacctgaggacacggctgtctattactgtgcgaaacggtatgagtgggtaactagggttt

SEQ ID NO: 529521 - DNA, 509 bp, Homo sapiens
  misc_feature: HEFZJCU01AHIZW.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaagggcttctggaggcaccgttcaacaactatgctgtcagctggatgcgacaggcccctggacaagggcttgagtggatgggaggagtcatccctctctttcgttcagcagactacgcacagaaattccaggacagagtcacgattaccgcggacgaagtccacgaccacagccctacatagagctgcgcagcctgagatctgaagacacggccatttattactgtgcgagagatgcagggccctcccgacatcggttatttctttgacttcctcgggggcctacggggaaccctggtcctaccggtcctccgtccg

SEQ ID NO: 529522 - DNA, 490 bp, Homo sapiens
  misc_feature: HEFZJCU01EUBOQ.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccaagggacacgtccatcagcaacgtcatcagcacacgcctacagtcggacctgaggcggcgtagacaagtcgtgacgaacgacggccgtatacttctgtgcggagg

SEQ ID NO: 529523 - DNA, 522 bp, Homo sapiens
  misc_feature: HEFZJCU01A2RCH.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtccttcccctcggccgccctcgctccaggagcacctccgagagcacagccggccctcgggctcg

SEQ ID NO: 529524 - DNA, 315 bp, Homo sapiens
  misc_feature: HEFZJCU01EP1BZ.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccagtcggtccttccccctggcaccctcctccaagagcacctctgggggcacagcggccctgggctgcctggtcaaggactacttcctagagacacg

SEQ ID NO: 529525 - DNA, 510 bp, Homo sapiens
  misc_feature: HEFZJCU01B4ZUB.53.81.H04.1.454.heavy.3.raw
cgcgtatacacacgaccggtgctcgatttagtagtgtagattcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaaacagcctgagagctgaggaccacggctctttattacgtgtgtcgagagatttctggattacgagccatttactttac

SEQ ID NO: 529526 - DNA, 437 bp, Homo sapiens; identical to SEQ ID NO: 444603
  misc_feature: HEFZJCU01EHVM0.3.21.B10.1.454.heavy.3.raw

SEQ ID NO: 529527 - DNA, 537 bp, Homo sapiens
  misc_feature: HEFZJCU01ED0RE.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacgatctattactttgggagcacctactacaacccgtccctcaagagtcgagtaacgatctcagtggacacgtctaacaatcacctctccctgaggctgagctctgtgacagccgcggacacgggcgtttattactgtagcgagagggacggacgtacggtgacgtacgtgggggttcgaccccgtggggcccaggggaaccctggtaccaccgtctcctcacgcctccaccg

SEQ ID NO: 529528 - DNA, 520 bp, Homo sapiens
  misc_feature: HEFZJCU01BNB7B.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaaggcccatcggtcttcccctggccg

SEQ ID NO: 529529 - DNA, 517 bp, Homo sapiens
  misc_feature: HEFZJCU01B5RX0.51.24.C02.1.454.heavy.3.raw
cgatcgtatacacgaccggtgctcgatttagtacagatcgttagggaaaggggggggagaggagcccagcactagaagtcggcggtgtttccattcggtgatcagcactgaacacagacgactcaccatggactttgggctgagctgggttttcctcgttgctcttttaagaggtgtccactgtcaggtgcagttggtggagtctgggggaggcgcggtccagcctgggaggtccctgaggctctcctgcgcgtccctctggactccccttcagcacttatgacatgcactgggtccgccaggctccaggcaaggggctggagtgggtggcagtcatatcatatgatgggaaaggataagtactatgcagactccatgaagggccgatccaccatctccagggacaattccaagaacacactgtatctgcaaataaacaacctagagtagttgcggacacggctgtctattactgtgcggcacgtgggggactacggtgacgacgtcactcctaccc

SEQ ID NO: 529530 - DNA, 500 bp, Homo sapiens
  misc_feature: HEFZJCU01CMSTT.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaaccacagtctacatgcaactgacgagcctgagagctgacgacacggccgtctattactgtgcgagaatgttttctgtcatcgtacaattgataggctctatgactgacttcgtc

SEQ ID NO: 529531 - DNA, 503 bp, Homo sapiens
  misc_feature: HEFZJCU01BT5A2.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggtcccgttttattacttggtgcggagtagtttaccggtggggggtccgtacgggcggata

SEQ ID NO: 529532 - DNA, 522 bp, Homo sapiens
  misc_feature: HEFZJCU01CHOVQ.3.17.B06.1.454.heavy.3.raw
  modified_base (447)..(447): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaagggctggagtgggttggccgttctagagacacaactaacagtgacaccgcacaatacgccgcgtctgtgaaaggcagattcaccatctcaagagatgattcagagaactcactttatctgcaatgaacagcctganaaccgacgacacggccgtctattattgtgttcattagaccttaggatacaacggacggtggtaacctggtattcc

SEQ ID NO: 529533 - DNA, 510 bp, Homo sapiens
  misc_feature: HEFZJCU01BMU06.49.59.F04.1.454.heavy.3.raw
  modified_base (186)..(186): a, c, t, g, unknown or other
agtcgagagacacgaccggtgctcgatttagtacacacacttagggattggggagcatcacataacaaccagattcctcctctaaagaagcccctgggagcacagctcatcaccatggactggacctggaggttcctctttgtggtggcagcagctacaggtgtccagtcccagtccggggggganctggtgcaatctggggctgaggtgaagaagcctgggtcctcggtgaaggtctcctgtaaggcttctggaggcaccctcagcagttatactatgaattgggtgcgacaggccctggacaagggcttgagtggatggggaggatcatccctattggttggtgtgacaaactacgcacagaacgttccaggacagaatcacgataaccgcggacacatccacgagcactattttcattggaactgagcagcctcagatccgaggacacggccgtttactactgtgcgagcgactccggattcccgcgtttcgaggatgaccttacgt

SEQ ID NO: 529534 - DNA, 503 bp, Homo sapiens
  misc_feature: HEFZJCU01EUYOV.17.25.C03.1.454.heavy.3.raw
  modified_base (435)..(435): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacganacggccgtctattactgtgcgagagtcccaagctccggtgagcctacggcagcggcctttgacttctc

SEQ ID NO: 529535 - DNA, 506 bp, Homo sapiens
  misc_feature: HEFZJCU01D3IZR.3.17.B06.1.454.heavy.3.raw
  modified_base (435)..(435): a, c, t, g, unknown or other
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttanctgacaaatgaacagcctgagaaccgagacacggcgtctattattgtgtcatagacctaggatacaacgac

SEQ ID NO: 529536 - DNA, 509 bp, Homo sapiens
  misc_feature: HEFZJCU01C55ZJ.51.61.F06.1.454.heavy.3.raw
  modified_base (378)..(378): a, c, t, g, unknown or other
cgatcgtatacacgaccggtgctcgatttagctacgctctaagggaaagggggggagaggagcccagcactagaagtcggcggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtgcagttattcatatgatggaagtaaatattctatgtagactcgtgaagggccncttcatcatctccagagacaattcccagaacaccttgtttctgcaaatgacacacgcctgacgacctgaaggcacggctgtgtattactgtcgcgaacttatcacggaggacaacgggtcgacccccgtcg

SEQ ID NO: 529537 - DNA, 528 bp, Homo sapiens; identical to SEQ ID NO: 470323
  misc_feature: HEFZJCU01CG21X.12.86.H09.1.454.heavy.3.raw

SEQ ID NO: 529538 - DNA, 508 bp, Homo sapiens
  misc_feature: HEFZJCU01DZIIU.19.67.G01.1.454.heavy.3.raw
  modified_base (462)..(462): a, c, t, g, unknown or other
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtntattattgtgtgagagtttatggcatggctggtggacagatcactc

SEQ ID NO: 529539 - DNA, 520 bp, Homo sapiens
  misc_feature: HEFZJCU01ELAFC.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggccaccctccctcccaagagcacctctgggggcacagcggccctgggctgcctggtcaaggactcttccagacgtatca

SEQ ID NO: 529540 - DNA, 533 bp, Homo sapiens
  misc_feature: HEFZJCU01DS1HR.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgtgaaagatacgaagtctatgatacccaatttgggaggggccgtttcatgtctggggccaagggacgctggtcaccgtctcttcagcctccaccaagggcccatcggtcttcccctggcaccctcctccaagagcacctctgggggcac

SEQ ID NO: 529541 - DNA, 529 bp, Homo sapiens
  misc_feature: HEFZJCU01EUXTJ.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagcctttcggagaccctgtccctcacctgcactgtctctggtgactccatcagcagtagtacttactactggggctggatccgccagcccccagggaaggggctggagtggattgggagtatctattataagtgggagtacctactacaacccgtccctcaagagtcgactcaccatatccgtagacacgtccaagaaccagttctccctgaagctgagctctgtgaccgccgcagacacggctgtgtattactgtgcggagggggccggggattattgtttatagtaaccacctgcctatcttgagctggttcgactgctgggggcccaggggaaccccgtggtacctacccg

SEQ ID NO: 529542 - DNA, 347 bp, Homo sapiens; identical to SEQ ID NO: 450801
  misc_feature: HEFZJCU01EWS3C.52.78.H01.1.454.heavy.3.raw

SEQ ID NO: 529543 - DNA, 537 bp, Homo sapiens
  misc_feature: HEFZJCU01A4IGD.7.78.H01.1.454.heavy.3.raw
  modified_base (471)..(471): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggattggatcaacaccgacactgggaaccccacctatgcccaggccttcacagggcggtttgtcttctccatggatacctctgtcgggcggcttatctgcagataaccaaccttcaacctgacgacactgccgtttatttttgtacgtagagcgtcgtctgtnagtggaattgactactggggccgacgggaaccctggtctaccggtcctcctcagccctccacccaa

SEQ ID NO: 529544 - DNA, 522 bp, Homo sapiens
  misc_feature: HEFZJCU01DEJYM.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccccaaactccaggcaagggattggatgggtgcagttgtttcatctgagggcagtgttcaatggtatgctgacgccgtgagggcgattcaccatctccagagacaactccaggaacacaatagtatttggacctgaacagcctagtcctgaggacgacgggtagtatactactgtacgaagggaaggggggaaccgaggacgggagtaccgtaagtactcctttacg

SEQ ID NO: 529545 - DNA, 506 bp, Homo sapiens
  misc_feature: HEFZJCU01D118G.10.28.C06.1.454.heavy.3.raw
catagtagtgcacgaccggtgctcgatttagagctcacgtattgggtttgggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgataagaaatagtggaaccatatactatgcagactctgtgaggggccgattcaccatctccagagacaatgccaggaattcactgtatgtggaaatgaacagtctgagagccgaggacacggctctctattactgtgcgagacgcccgaaatac

SEQ ID NO: 529546 - DNA, 589 bp, Homo sapiens
  misc_feature: HEFZJCU01DC8XO.49.27.C05.1.454.heavy.3.raw
agtcgagagacacgaccggtgctcgatttagacgcgatcgaaggggtctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggctggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaatgaatggcctgttttgcggacacggtctgtttattattgtgtcgacgacggggggccccccctttccgtaccgggtaggcgtacgtactacgttaaccttacttttacggtacctaccttacggggtcccggtacggggaaaccccggttaccgggttcccgg

SEQ ID NO: 529547 - DNA, 517 bp, Homo sapiens
  misc_feature: HEFZJCU01B2BDI.17.25.C03.1.454.heavy.3.raw
  modified_base (345)..(345): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccntcctccgggacagacttaccatgaccacgaactcctccataaacacagcctaccatggagttgaggagcctgacatctgacgcacggccgtctattactgtgcgagagtcccacgatccggtgagcctaccggcaggcggtcctttcgtacttcgtcgggggccaggggtac

SEQ ID NO: 529548 - DNA, 509 bp, Homo sapiens
  misc_feature: HEFZJCU01E10O6.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaaggtttcagggcagggtcgaccatgaccagggacacggtccatcagtacagcctacatggagctgagcagtctgagacctgacgacacggccgtgtattattgtgcgttagttacggacgagttacgaacgttttcgtattggttacg

SEQ ID NO: 529549 - DNA, 520 bp, Homo sapiens
  misc_feature: HEFZJCU01CPEPD.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggggccgattcaccatctccagagacaattccaagaacacgctgtttcttcaatgaacagcctgagagccgatgacacggccgtgtattactgtgcgagagatggggcccacgtaacgttactacgctatggacgtcgtgggcgaagggaccg

SEQ ID NO: 529550 - DNA, 493 bp, Homo sapiens
  misc_feature: HEFZJCU01CBYQR.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgacggacacgggccgtatatttattgtgtcccgttgatttacta

SEQ ID NO: 529551 - DNA, 521 bp, Homo sapiens
  misc_feature: HEFZJCU01D4O31.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccttggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattacttgcgcgagagagacacacgaacctactggccaatactatgggggcttgttctggggccaggggaccctggtcatcgtctccccagccctccaccaagggcccatcggcttcccctgcg

SEQ ID NO: 529552 - DNA, 500 bp, Homo sapiens
  misc_feature: HEFZJCU01DCL7F.5.70.G04.1.454.heavy.3.raw
atcagacacgcacgaccggtgctcgatttagtgtagtgtgaagggaaagggggggagaggagccccagccctgagattcccaggtgtttccattcagtgatcagcactgaacacagaggactcaccatggagttgggactgaactggattttccttttggctatgttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattacttggaatagtggtgacataggctatgcggactctgtgaagggccgcttcaccatctccagagacaacgccaagaactccctgtatctacaaatgaaccagtctgagagttgaggacacggccttctattactgtgacaaagatcgggaccgaaggtgtgggtg

SEQ ID NO: 529553 - DNA, 531 bp, Homo sapiens
  misc_feature: HEFZJCU01BWWGE.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattaccaagaacacccttttatctgcaaatagacagcctgagaccagacgacacggctgtctattattgcgcgagagagacacacgaacctactggccaatactatgggggcttgttctggggcctaggggaccctgggtctagtcgtctccccagccctccaccaagggcccgatcggtcttccccctggccg

SEQ ID NO: 529554 - DNA, 506 bp, Homo sapiens
  misc_feature: HEFZJCU01DXZQC.51.43.D10.1.454.heavy.3.raw
  modified_base (459)..(459): a, c, t, g, unknown or other
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacaggcctatatggaggtgaccagcctgagccctgacgacacggccatatattttctgtgcgngagaatttcgacttctggaataattacttgggttagaaacgtacctt

SEQ ID NO: 529555 - DNA, 534 bp, Homo sapiens
  misc_feature: HEFZJCU01E1T8Z.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgacgaacacggtgtatcttcaaatagaacaacctgaggagccgacgacaccggtaccgtttattactagtgcgacgagattcgtagtgggttcggggtaccgtccgtaccctcggttcgttacttcgtatc

SEQ ID NO: 529556 - DNA, 522 bp, Homo sapiens
  misc_feature: HEFZJCU01APR4N.51.71.G05.1.454.heavy.3.raw
cgatcgtatacacgaccggtgctcgatttagtgtcgtcgcaagagagaggggctcttttaagaggcgtccagtgtcaggtgcagctggtggagtctgggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaataacggttcttctacaaatgaacagcctgagagctgaggacacggctatgttttactgtgcgagagggactacgattacagcagccctcgaacgaacatcatgatggctttgatatcgtggggccaaagggacaagtggtcattgtcttcttctagcctccacctaacgggcccatcggtccttcccccgtggccacccctccctacccaacgacg

SEQ ID NO: 529557 - DNA, 522 bp, Homo sapiens
  misc_feature: HEFZJCU01BQNLF.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggactttgagcagcctgaggtctgacgacacggccatgtattattgtgcgaggcgaggacggggctaaagggcataaagtggttcgacccctggggccagggaaccctggtcaccgtctcctcagcctccaccaagggcccatcggtcttcccctgcgcctgctccagagcacctccgagagcacagcggccctgggcg

SEQ ID NO: 529558 - DNA, 500 bp, Homo sapiens
  misc_feature: HEFZJCU01BWLRQ.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggagtccagcctggggggtccctgagactctcctgtgcagcctctgggttcagcatcagtaacgactacatgacctgggcccgccaggctccagggaaggggctggagtgggtctcagttattggaaacagatggcactacatattattctgactccatgaagggccggttcaccctctccagagacacttccaacaacatcttgtatcttcacatgcacaatctgagagtcgacgacacggccacctattattgtgcgcgacatgactacgctcaattcgtac

SEQ ID NO: 529559 - DNA, 509 bp, Homo sapiens
  misc_feature: HEFZJCU01EKKG5.10.28.C06.1.454.heavy.3.raw
  modified_base (312)..(312): a, c, t, g, unknown or other
catagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccnccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacgacggctctctatttactgtgcgagacgaccccgaaatac

SEQ ID NO: 529560 - DNA, 391 bp, Homo sapiens
  misc_feature: HEFZJCU01BSZ05.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggcctgcctggtcaaggactacttccgagtagtaca

SEQ ID NO: 529561 - DNA, 514 bp, Homo sapiens
  misc_feature: HEFZJCU01ERVZV.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgagacacgggtgtatactactgtacgaagggagggggaacgagcgggagttccaagtactctttg

SEQ ID NO: 529562 - DNA, 505 bp, Homo sapiens
  misc_feature: HEFZJCU01B156F.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcgacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggtcgacctctgggccac

SEQ ID NO: 529563 - DNA, 503 bp, Homo sapiens
  misc_feature: HEFZJCU01END4K.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaatgaacagcctgagagccgacgacacggccaatatattactgtgcgaaagcaccggcagttagtcacccatactactttgactact

SEQ ID NO: 529564 - DNA, 483 bp, Homo sapiens; identical to SEQ ID NO: 492951
  misc_feature: HEFZJCU01DW80X.7.10.A10.1.454.heavy.3.raw
  modified_base (477)..(477): a, c, t, g, unknown or other

SEQ ID NO: 529565 - DNA, 509 bp, Homo sapiens
  misc_feature: HEFZJCU01AUPAJ.21.19.B08.1.454.heavy.3.raw
tcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctggggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccgattcaccatctccagagacaacgccaagaattccctgtatctgcaaatggacagcctgagagtcgaggacacggctatgtattactggtgcggggtggcgtgggggcggggatgacagcgtggggccgac

SEQ ID NO: 529566 - DNA, 517 bp, Homo sapiens
  misc_feature: HEFZJCU01CN6N5.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaatgaacagtctgagacctgaggacgacggccttgttattactgtgtaaagtcccgggggaaatacgtagtacgtagttttta

SEQ ID NO: 529567 - DNA, 519 bp, Homo sapiens
  misc_feature: HEFZJCU01EC6Y8.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctacggcatgcactgggtccgccaagctccaggcaagggattggagtgggtgcagttgtttcatctgagggcagtgttcaatggtatgcagactccgtgaagggccgattcaccatctccagagacaattccaggaacacaatgtatttggaaatagaacagcctaagtctgagacgacgggtgtatactactgtacgaagggaggggggaaccgaggcgggagttccaagtacttccg

SEQ ID NO: 529568 - DNA, 498 bp, Homo sapiens
  misc_feature: HEFZJCU01AYT5M.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcgacctactacaacccgtccctcaaaagtcgaggcaccatatccgtagacacgtccaagaaccaattctccctgaagctgagctctgtgaccgccgcagacacggctgtctattactgtgcgaggccccgagcgcagtgctttttgtatgctttgatatgtggggccgaagggacgaat

SEQ ID NO: 529569 - DNA, 540 bp, Homo sapiens
  misc_feature: HEFZJCU01C3AED.7.78.H01.1.454.heavy.3.raw
  modified_base (389)..(389): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacactgggaaccccacctatgcccaggccttcacagggcggtttgtcttctccatggatacctntgtcgggacggcttatctgcagataaccaaccttcaacctgacgacactgccgtttatttttgtacgtagagcgtcgtctgtcagtggaattgactactgggccgagggaaccctggtcaccgtctcctcagccctccaccaacgggcccg

SEQ ID NO: 529570 - DNA, 523 bp, Homo sapiens
  misc_feature: HEFZJCU01DCREJ.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaaccccgtccctcatgagtcgagtcaccatgtcagtggactcgtccaagagtgagttctccctgaggctgacgtctttaagtgtcgctgatacgggtgtctatttctgtgcgagactggcccgtcctgcacctcgtgtcggccccaattttgggtttacccggcaccaacaaaatcaggggcaacggtccctacggacggtctac

SEQ ID NO: 529571 - DNA, 506 bp, Homo sapiens
  misc_feature: HEFZJCU01BYO3Z.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaagggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccgggggacacatgactacc

SEQ ID NO: 529572 - DNA, 478 bp, Homo sapiens
  misc_feature: HEFZJCU01B131C.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacacacggccgtatatttctgtgcgaggg

SEQ ID NO: 529573 - DNA, 515 bp, Homo sapiens
  misc_feature: HEFZJCU01COL95.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacagtactacgcagactccgtgaagggccggttcaccatctccagagacaattccaagaacacactgtatctgcaaatgaacagcctgagagccgaacgacacggccatatattactgtgcgaaagccaccggcagttagtcacccataccttactttgactacgtgggccg

SEQ ID NO: 529574 - DNA, 508 bp, Homo sapiens
  misc_feature: HEFZJCU01D8CSY.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctagagagtcgacgacacggccacctattattgtgcgcgacatgactacgctcaattcgtggggccagggacg

SEQ ID NO: 529575 - DNA, 523 bp, Homo sapiens
  misc_feature: HEFZJCU01D8VB0.4.57.F02.1.454.heavy.3.raw
  modified_base (514)..(514): a, c, t, g, unknown or other
agcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaatttcgagaacacattgaatctacagatgaacagtctgagagccgaggacacggctgtctattattgtgcgagagtaagtggtcatggtcctttgaccagtgggcagggaacctgtcacgtctcctcagcttccaccaacgggcccatccggtcttcccctcggccgcccctcgcctaccgaggagcaccgtcgtcgggggcacgngccggtccc

SEQ ID NO: 529576 - DNA, 508 bp, Homo sapiens
  misc_feature: HEFZJCU01DQWD4.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgacaaatgaacagcctgagagccgaggacacggctgtgtattactgtgcgagaggagctattatctacggaaccccgagtgttc

SEQ ID NO: 529577 - DNA, 499 bp, Homo sapiens
  misc_feature: HEFZJCU01C093D.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcggacaggcccctggacaagggcttgactacatgggatggatcaaccctaccagtggtggcacaaagtttgcgcagaagtttcagggcaggtcaccatgaccagggacacgtccatcagcactgcctacatggagctgaccaggctgaaatttgaggacacggccatttattactgtgcaaggaacagacataatgactcgtccccggacgtttcg

SEQ ID NO: 529578 - DNA, 490 bp, Homo sapiens
  misc_feature: HEFZJCU01BVR4J.4.37.D04.1.454.heavy.3.raw
  modified_base (442)..(442): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggccccctggacaagggcttgagtggatgggatggatcgaccctaacagcggtggcacaaagtatgcacagaaagtttcagggcaggggtcaccatgaccagggacacgtccatcagcacgtccatcagcacagcctacattggaccctgacgnggcctggacatctgaccgacacgggccgtatacttctcgtgcgaggga

SEQ ID NO: 529579 - DNA, 512 bp, Homo sapiens
  misc_feature: HEFZJCU01CJJZG.48.12.B01.1.454.heavy.3.raw
agtatacatacacgaccggtgctcgatttagtagtgtagattccgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcaggaatcacacttaccgcggacaatccacgggcacagcgcagttggacctgagcggcctgagacctgaggacacggccatttactactgtgcgcggggaggtggacggagcgtcggttttcggaggtttatcatctactacttttgt

SEQ ID NO: 529580 - DNA, 516 bp, Homo sapiens
  misc_feature: HEFZJCU01A3HGH.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctgggagtgggtctcagttattgaaacagaatggcactacatattattctgactccgtgaagggccggttcaccctctccagagacacttccaacaacatcttgtatcttcacatgcacaatctgagagtcgacgacacggcccacctattacttgtgcggcgacatgacctacgctcaattcgtcggggccaggggaccg

SEQ ID NO: 529581 - DNA, 533 bp, Homo sapiens
  misc_feature: HEFZJCU01CLHOC.7.78.H01.1.454.heavy.3.raw
  modified_base (429)..(429): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctnacgacactgccgttttatttttgtacgtagagcgtcgtctgtcagtggaattgactactggggccagggaccctggtcaccgtctcctcagcctccaccaaggg

SEQ ID NO: 529582 - DNA, 494 bp, Homo sapiens
  misc_feature: HEFZJCU01C2H58.13.86.H09.1.454.heavy.3.raw
  modified_base (483)..(483): a, c, t, g, unknown or other
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcgagtggatatcganaaattacttaa

SEQ ID NO: 529583 - DNA, 525 bp, Homo sapiens
  misc_feature: HEFZJCU01BTV91.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggaacagcctaagagttgaggacacggctgtttattactgtacgaaagaggggggatacagtggcagctccaagtactactttgacttctgggccagggaacctggtcaccgtctcctcagcctccaccaagggcccatcggtcttccccctggccgccctcgctccaggagcacctccg

SEQ ID NO: 529584 - DNA, 519 bp, Homo sapiens
  misc_feature: HEFZJCU01BOQNH.7.78.H01.1.454.heavy.3.raw
  modified_base (465)..(465): a, c, t, g, unknown or other
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccaccaaggcccatcggtcttcccctggcacctcctccaagagcacctcngggggcacagcggccctgggcctgcctggtcaaggactacttcctagagacacg

SEQ ID NO: 529585 - DNA, 497 bp, Homo sapiens
  misc_feature: HEFZJCU01BCB5J.53.81.H04.1.454.heavy.3.raw
cgcgtatacacacgaccggtgctcgatttagtagtgtagattcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctcctaaatgaacagcctgagagctgaggacacggctctttattactgtgcgagagattctggatacagcct

SEQ ID NO: 529586 - DNA, 511 bp, Homo sapiens
  misc_feature: HEFZJCU01D4739.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcactgagtcgagtcaccatgtcagtggactcgtccaagagtgggttctccctgaggctgacgtctttaagtgtcgctgatacgggtgtctatttctgtgcgagactgcccggtcctgcacctcgtgtggccccaattttcggtttaccggcacacaaaatcagggcaagtcctacgacggtctgg

SEQ ID NO: 529587 - DNA, 504 bp, Homo sapiens
  misc_feature: HEFZJCU01DT73A.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggcctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccacc

SEQ ID NO: 529588 - DNA, 525 bp, Homo sapiens
  misc_feature: HEFZJCU01DY91P.12.40.D07.1.454.heavy.3.raw
atacgacgtacacgaccggtgctcgatttagtgatagagcgtaacaacagagggctcaccatggagtttgggctgagctgggttttcctcgttgctctttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccaatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccccgtgcg

SEQ ID NO: 529589 - DNA, 508 bp, Homo sapiens
  misc_feature: HEFZJCU01CSH8G.47.48.E04.1.454.heavy.3.raw
  modified_base (445)..(445): a, c, t, g, unknown or other
  modified_base (485)..(485): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctganagtcgaagacacggctgtgtattactgtgtgtctctgacnctcggcccggactcggctttcgg

SEQ ID NO: 529590 - DNA, 503 bp, Homo sapiens
  misc_feature: HEFZJCU01BTTSF.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaaggcccatcggtctcccctcggcg

SEQ ID NO: 529591 - DNA, 397 bp, Homo sapiens
  misc_feature: HEFZJCU01D7N62.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactaccttcctacgtgagct

SEQ ID NO: 529592 - DNA, 515 bp, Homo sapiens
  misc_feature: HEFZJCU01D6IRB.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatccctccgcagtcgacactttgattactggggccggggaaccctggtcgccgtctcctcagcctccaccaagggcccatcgtcttcccctggcaccctcctccaagagcacctctgggggcacagcggccctggctgcctggtcaaggactacttccagacgtatca

SEQ ID NO: 529593 - DNA, 509 bp, Homo sapiens
  misc_feature: HEFZJCU01D0PRQ.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcctgg

SEQ ID NO: 529594 - DNA, 502 bp, Homo sapiens
  misc_feature: HEFZJCU01COAT7.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagccactcccaggtgcagctggtgcagtccgggggtgaagtgaagaagcctgggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccagtgaccaggggagacggtaccgtcaggacagcctatatggaggtgaccagcctgagccctgacgacacggccgatatatttctgtgcgcgaggaatttcggacttctggaatattacttgggttggaaact

SEQ ID NO: 529595 - DNA, 365 bp, Homo sapiens
  misc_feature: HEFZJCU01AO6G2.11.20.B09.1.454.heavy.3.raw
cgagagataccacgaccggtgctcgatttagtgtagtgtgaagggactggagtggattggtcatatcgataccactggaaacaccaattacaacccctccctcaagagtcgagtcaccatatccctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagtggccctgggctgcctggtcaaggactacttccgtatctctcg

SEQ ID NO: 529596 - DNA, 555 bp, Homo sapiens
  misc_feature: HEFZJCU01A9MWB.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctggtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagacactttttttgacttattggggtccagggaaagtccgtcggtcgaccgtcgcccttccacgccttcccacccaacgggcccgacgtccggtcgtttccccccg

SEQ ID NO: 529597 - DNA, 533 bp, Homo sapiens
  misc_feature: HEFZJCU01B78T6.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaagggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctagtcagtggaattgactactggggccagggaacccttggtcaccgtctcctcacgcctccaccc

SEQ ID NO: 529598 - DNA, 504 bp, Homo sapiens
  misc_feature: HEFZJCU01D6G1X.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggccgccctgctccaggagcacctccgagagcacagcggcctgggctgcctggtcaaggactacttctagacgtatca

SEQ ID NO: 529599 - DNA, 559 bp, Homo sapiens
  misc_feature: HEFZJCU01D4SVJ.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgttcgtgggggtccgtagggacctacgggtacacccgtcctccctccacgcccttcccaacccaaacggggccccgacgtccgggttccctttccccccgttcgggccctacccccg

SEQ ID NO: 529600 - DNA, 527 bp, Homo sapiens
  misc_feature: HEFZJCU01C3WHF.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctggggggagacttggtccagcctggcaagtccctaagactctcctgtgtcgcttctggattcacctttgatgaatatgccatgcactgggtccgtcaggccaccagggaggggcctgggagtgggtctcaggtatcagttacaatagtggtaatatactctatgcggactctgtgaagggccgattcaccatctccagagacaacgccaggaactccctctatctagaaatggacagtctgacaactgaggacacggtccttttattctgttagcgaaaggtggaaccgacattatttccacaagtctaggcacgtggttacttcg

SEQ ID NO: 529601 - DNA, 518 bp, Homo sapiens
  misc_feature: HEFZJCU01CP4MV.3.6.A06.1.454.heavy.3.raw
agacgcactccacgaccggtgctcgatttagatctactgacaggggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttactactactggagttggatccggcagtccccagggaagggactagagtgggttggccatatgcatcacagtgggagcaccaactacaacccctccctcgagagtcgagtcaccatatcaatagacacgtccaagaaccagttctccctgagcttgaagtctgtcaatgctgcggacacggccgtttattactgtgcgagtactggacggggaaagagtcctatttgattatttgggggccaaggaacaatggtcaccgtctcttcagcctccacc

SEQ ID NO: 529602 - DNA, 519 bp, Homo sapiens; identical to SEQ ID NO: 445330
  misc_feature: HEFZJCU01BGP29.7.78.H01.1.454.heavy.3.raw

SEQ ID NO: 529603 - DNA, 507 bp, Homo sapiens
  misc_feature: HEFZJCU01DEKRG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccggggacagacttaccatcgaccacgaactcctccataaacacagcctacatggagttgaggagcctgacatctgacgacacggccgtctatttactgtgcggagagtcccacgatctggtgagcctacggcagcggcctttgaccttcg

SEQ ID NO: 529604 - DNA, 521 bp, Homo sapiens
  misc_feature: HEFZJCU01DAGHZ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgatgggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccgggaaccctggtcgccgtctcctcagcctccaccaagggcccatcggtccttcccctcggcaccctcctccaagagcacctcgtgggggcacagcggccctgggctgccgtggtcaaggactacttccagtacgtatcc

SEQ ID NO: 529605 - DNA, 523 bp, Homo sapiens
  misc_feature: HEFZJCU01C01K0.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactacgtggggccagggagcttggtcaccgtctcctcagcctccg

SEQ ID NO: 529606 - DNA, 547 bp, Homo sapiens
  misc_feature: HEFZJCU01CPAYG.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggccggttacccctctcggtttccttcgactaagttatggtatggacgtcgtcgggggcctagggacgttacgggtccacccgtctccctcacgtccctccctacccgaaacgggccccacgttccggttccctttcccccgtcgg

SEQ ID NO: 529607 - DNA, 529 bp, Homo sapiens
  misc_feature: HEFZJCU01C33WT.48.67.G01.1.454.heavy.3.raw
agtatacatacacgaccggtgctcgatttagagtatacatattgggtttggggatgctttctgagagtcatggatctcatgtgcaagaaagtgaagcacctgtggttctccctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctccatatccatagacacgtccaacaacccagttttccctgacgcctgacgtctgtgaccgccgcagacacggctgtctattattgtgcgagactaggcttctgtagtggtggtacttgcacccgggatacctactccaacttcggctttggacatctggggccaggggaccttc

SEQ ID NO: 529608 - DNA, 530 bp, Homo sapiens
  misc_feature: HEFZJCU01CVZH5.16.27.C05.1.454.heavy.3.raw
  modified_base (523)..(523): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtggtggcgtttatttcatatgatggaactactcaacactatccagactccgggggagggcccgattcaccgtctccagagacaattccaagaacagggtgtttctccaagtgattgatctgagaagtgaggacacggctgtttattactgtgcgcggtggctgaccgctcttgactacgtgggggccggggtacgccccggtnatcgtct

SEQ ID NO: 529609 - DNA, 352 bp, Homo sapiens
  misc_feature: HEFZJCU01EWB0T.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatcgaacag

SEQ ID NO: 529610 - DNA, 414 bp, Homo sapiens
  misc_feature: HEFZJCU01B078O.13.86.H09.1.454.heavy.3.raw
tcacgtactacacgaccggtgctcgatttagtgctatagacttgggtttgggtccgcctgtccccagggaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctcccgagagcacagcggccctgggctgcctggtcaaggactacttcctagtacgtga

SEQ ID NO: 529611 - DNA, 496 bp, Homo sapiens
  misc_feature: HEFZJCU01D1I1S.19.59.F04.1.454.heavy.3.raw
tactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctggggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatctccagagacagcgccaagaactcactgtatctgacaaatgaacagcctgagagccggaggacacgggcagtttattactgtgcgagagagtggc

SEQ ID NO: 529612 - DNA, 499 bp, Homo sapiens
  misc_feature: HEFZJCU01C2K4U.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtagacgtggtagttccggggggacgac

SEQ ID NO: 529613 - DNA, 499 bp, Homo sapiens; identical to SEQ ID NO: 452982
  misc_feature: HEFZJCU01BK280.11.71.G05.1.454.heavy.3.raw

SEQ ID NO: 529614 - DNA, 494 bp, Homo sapiens
  misc_feature: HEFZJCU01AW416.51.64.F09.1.454.heavy.3.raw
  modified_base (442)..(442): a, c, t, g, unknown or other
cgatcgtatacacgaccggtgctcgatttagcgcgtatacaagggggctctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatacgtatacagactccgtgaagggccgattcaccatctccagagacaattccaagaactcgctctatctgcaaatgagcagcctganacctgaggacacggctgtctattactgtgcgaaacggatgagtgggaactta

SEQ ID NO: 529615 - DNA, 507 bp, Homo sapiens
  misc_feature: HEFZJCU01D09WD.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaagggctggagtgggtttcatatattgatagaaatagtggaaccatatactatgcagactctgtgaggggccgattcaccatctccagagacaatgccaggaattcactgtatgtggaaatgaacagtctgagagccgaggacacggctcgtcttattactgtagcgagacgaccccgaaaa

SEQ ID NO: 529616 - DNA, 545 bp, Homo sapiens
  misc_feature: HEFZJCU01D0588.18.33.C11.1.454.heavy.3.raw
tacgagtatgcacgaccggtgctcgatttagagtgagctcgttggggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattacttgtgtgggggcattttacttgaccccgtgggggcccgggggtaacccgtggtcacccgtcctccccaccccttccaacccg

SEQ ID NO: 529617 - DNA, 348 bp, Homo sapiens
  misc_feature: HEFZJCU01BE5J0.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcaccttttaacagttattggatgacttgggtccgccaggctccagggaaggggctggagtgggtggccagcgtgaagca

SEQ ID NO: 529618 - DNA, 499 bp, Homo sapiens
  misc_feature: HEFZJCU01DVRK7.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggcaaggacttgagtggatgggatggttcaaccctgacactggtgtcgcaacctatgcacagaggtttcagggcagggtcaccatgaccagggacacggttccatcagcacagcctacatggagctacacggcctgagatctgacgacacggccctggttatttttggtcgtcggagagagtactagtttaaagtggcgttc

SEQ ID NO: 529619 - DNA, 491 bp, Homo sapiens
  misc_feature: HEFZJCU01EVKO7.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctggaccgacacggccgtgtatttttgttgtgagagattttcggactaactccagagacccct

SEQ ID NO: 529620 - DNA, 549 bp, Homo sapiens
  misc_feature: HEFZJCU01DB2DO.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccccgtcgggggcccgggaacccgtcggtcaccggtcctcctccagccctcccaccgaacggcccactccggtccttccccctc

SEQ ID NO: 529621 - DNA, 501 bp, Homo sapiens; identical to SEQ ID NO: 492593
  misc_feature: HEFZJCU01EP4CG.17.10.A10.1.454.heavy.3.raw

SEQ ID NO: 529622 - DNA, 521 bp, Homo sapiens
  misc_feature: HEFZJCU01DT8MK.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctgcaaggactacttccgtgtctgat

SEQ ID NO: 529623 - DNA, 546 bp, Homo sapiens
  misc_feature: HEFZJCU01DKOAG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccattctccagagacaattacaagaacaccctttatctgcaaatagacagcctgagaccagacgacacggctgtctattattgcgcgagagagacacacgaacctactggcccaatactatgggggcgttgttctggggtccgacgggggacccgtcggtcgatcgtcctccccacgcctcccaccgaacggcccgactcggtcttcccccgtcggccgcctcg

SEQ ID NO: 529624 - DNA, 517 bp, Homo sapiens; identical to SEQ ID NO: 510714
  misc_feature: HEFZJCU01CI6PE.9.34.D01.1.454.heavy.3.raw

SEQ ID NO: 529625 - DNA, 493 bp, Homo sapiens
  misc_feature: HEFZJCU01EQSWJ.49.23.C01.1.454.heavy.3.raw
agtcgagagacacgaccggtgctcgatttagtacacgtgattagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaactagtctgagacgtgaagacacggctgtctattactgtgcgactgagatgtcttta

SEQ ID NO: 529626 - DNA, 504 bp, Homo sapiens
  misc_feature: HEFZJCU01C2AKA.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctccctcagcctccaccaagggcccatcggtcttcccctggcgccctgctccaggagcacctccgagagcacagcggcccgtgggctgcctggtcaaggacgtacttccagtatagtct

SEQ ID NO: 529627 - DNA, 504 bp, Homo sapiens
  misc_feature: HEFZJCU01EUMFW.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaagggctggagtgggttggccatataaaaagtagactgctggtgagacaacagactacgctgctgccttcagaggcagattcaccatccttcagagatgaatcacagagcactctgtttctgcaaatgaacagcctggaacgacgcggacacagccatgtattattgtactagtaggacaactatacg

SEQ ID NO: 529628 - DNA, 504 bp, Homo sapiens
  misc_feature: HEFZJCU01DH5AT.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgttctgggggaccg

SEQ ID NO: 529629 - DNA, 496 bp, Homo sapiens
  misc_feature: HEFZJCU01B8JYS.19.59.F04.1.454.heavy.3.raw
tactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctgggggagcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatctccagagacagcgccaagaactcactgtatctgcaaatgaacagcctgagagccgaggaccacggcagttttattactgtgcgagagagtgctaaa

SEQ ID NO: 529630 - DNA, 511 bp, Homo sapiens
  misc_feature: HEFZJCU01AQXFG.17.25.C03.1.454.heavy.3.raw
  modified_base (497)..(497): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacacgcctacatggagttgaggagcctgacatctgacgacacggccgtctattctgtgcgagagtcccacgatccgggtgagcctacggcagcggcctttgacttcgnggggccaggggacg

SEQ ID NO: 529631 - DNA, 540 bp, Homo sapiens
  misc_feature: HEFZJCU01DDZV1.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaaggcccatcggtcttcccctggccaccctcctccaacgagcacctctgggggcacagcc

SEQ ID NO: 529632 - DNA, 521 bp, Homo sapiens
  misc_feature: HEFZJCU01A5BP1.51.83.H06.1.454.heavy.3.raw
cgatcgtatacacgaccggtgctcgatttagatcacgtgcgtcgcggggcggggggaagaggaagactgacggtcctcccaggagttcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaacacgctgtatctccaaatgaacagcctcagatctgaggacacggcatctactactgtgtgaagaatgggtttcagtggctactttgacttctggggccagggaaccctggtcaccgtctcctcagcttccaccaagggcccatcggtcttcccctggcgccctgctccaggagcgacctctggggggtcacgacgcggccccgtc

SEQ ID NO: 529633 - DNA, 517 bp, Homo sapiens
  misc_feature: HEFZJCU01BNKO5.9.34.D01.1.454.heavy.3.raw
tgatacgtctcacgaccggtgctcgatttagatcgtctgtgttgggtctgggggaggcttggtccagccctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagagcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctcggcaccctcctccaagagcacctctgggggcacagcggccctgggctgcctggtcaaggactacttccagacgtatc

SEQ ID NO: 529634 - DNA, 519 bp, Homo sapiens
  misc_feature: HEFZJCU01ADK0A.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggggtagttagttagtccctactttgactactggggccgagggaactctggtcaccgtctccgcagcctcaccagggcccatcc

SEQ ID NO: 529635 - DNA, 390 bp, Homo sapiens
  misc_feature: HEFZJCU01ADGQT.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactgggccagggaaccctggtcaccgtctcctcagcctccaccaagggcccatcggtcttccccctggcaccctcctccaagagcacctctgggggcacagcggcctgggctgcctggtcaaggactacttccgagtagtaca

SEQ ID NO: 529636 - DNA, 519 bp, Homo sapiens
  misc_feature: HEFZJCU01DDTDI.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgaccacggccgtctattactgtgcgagacgtcccacgatcccgggtgacgccgtaccggcaacggcggtccctttgacctttcgtcc

SEQ ID NO: 529637 - DNA, 519 bp, Homo sapiens
  misc_feature: HEFZJCU01A2SPX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctctttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 529638 - DNA, 496 bp, Homo sapiens
  misc_feature: HEFZJCU01BD79I.13.86.H09.1.454.heavy.3.raw
  modified_base (435)..(435): a, c, t, g, unknown or other
  modified_base (456)..(456): a, c, t, g, unknown or other
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacganacggccgtgtatttattgtgnaggagtggagtggcagtggatagtcgacaaattactaacg

SEQ ID NO: 529639 - DNA, 382 bp, Homo sapiens
  misc_feature: HEFZJCU01D4BL4.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggctacttccgtatctctcg

SEQ ID NO: 529640 - DNA, 394 bp, Homo sapiens
  misc_feature: HEFZJCU01C4319.16.17.B06.1.454.heavy.3.raw
tgtactactccacgaccggtgctcgatttagtcgatagtgaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcggagtgactatgatcccaggtcccctttgactcctggggccagggaaccctggtcaccgtctcctcagccttccaccaagggcccatcggtcttccccctggcgccctgctccaggagcacctccgagagcacagcggccctgggctgcctggtcaaggactacttccgagtagtaca

SEQ ID NO: 529641 - DNA, 541 bp, Homo sapiens
  misc_feature: HEFZJCU01EQ3E3.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaaacataaagcaaagatggaactgccgagttttacgtggactctgtgaagggccgtttcaccatctccagagacaacgccaagaattcactgtatctacaactgaacagcctgagagtcgcagacaccggccgtgtattactgtgcgagatgtaggaaaaagtatggcttgtgtttagttggggccagggagccctggtctaccg

SEQ ID NO: 529642 - DNA, 511 bp, Homo sapiens; identical to SEQ ID NO: 488938
  misc_feature: HEFZJCU01D7AX4.17.33.C11.1.454.heavy.3.raw

SEQ ID NO: 529643 - DNA, 478 bp, Homo sapiens
  misc_feature: HEFZJCU01D7BHI.19.68.G02.1.454.heavy.3.raw
  modified_base (467)..(467): a, c, t, g, unknown or other
tactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatctccggggacagtgtctctagtgacagcgcaacttgggactggctcaggcagtccccatcgagaggccttgagtggctgggaaggacatactacaggtccacgtggtatgatgattatgcagtatctgtgaaaagtcgatttaccattaagccagacacatccaagaccagttctccctgccacttgaactctgtgactcccgacgacacggctgtctattactgtgcaagngctcgcaaggg

SEQ ID NO: 529644 - DNA, 507 bp, Homo sapiens
  misc_feature: HEFZJCU01AT8ER.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgacaaaagatacccaacccctacgttacg

SEQ ID NO: 529645 - DNA, 530 bp, Homo sapiens
  misc_feature: HEFZJCU01EIQZU.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagacccgtgaagggccggttcaccatctccagagacaattccaagaacacactgtatctgcaaatgaacagcctgagagccgacgacacggccaatagtattactcgtgtacgaaagtcaccgggacagttagtacacccgataccgtaactttcggaactactcggggccgtaac

SEQ ID NO: 529646 - DNA, 517 bp, Homo sapiens
  misc_feature: HEFZJCU01AXZ3S.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgccacctcgtgtggccccaattttggtttaccggcacacaaaatcaggcaagtccctacgacggtctggtacgg

SEQ ID NO: 529647 - DNA, 514 bp, Homo sapiens
  misc_feature: HEFZJCU01A06MU.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctgggacggccctcggacacccgccatatattactgtgcgagtccggttatcgccgcagatcactactactactacggtctggacgtcgtggggcc

SEQ ID NO: 529648 - DNA, 492 bp, Homo sapiens; identical to SEQ ID NO: 445919
  misc_feature: HEFZJCU01BV1RF.14.25.C03.1.454.heavy.3.raw

SEQ ID NO: 529649 - DNA, 504 bp, Homo sapiens
  misc_feature: HEFZJCU01BVDCR.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggaatgggcgaaccataacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttcg

SEQ ID NO: 529650 - DNA, 526 bp, Homo sapiens
  misc_feature: HEFZJCU01ED2FN.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaagggctggagtgggtggccaatatacagtcaggtggaggtacgatacactatctcgactctgtgaagggccggttcaccatctccagagacaacgccaagaattcactgtatctgacaaatgaacagcctgagagtcgaaagacacgggtatttattattgtgtgcgagatctggtatttccttcgaaatgaagtgtggtcgatgtgttgattcgg

SEQ ID NO: 529651 - DNA, 490 bp, Homo sapiens
  misc_feature: HEFZJCU01C20KB.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccagtgcgtct

SEQ ID NO: 529652 - DNA, 505 bp, Homo sapiens
  misc_feature: HEFZJCU01B7990.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggcgtatattttctgcgcgagagacgtaaaagtgacgtgtattccggggggacgacatgacacc

SEQ ID NO: 529653 - DNA, 506 bp, Homo sapiens
  misc_feature: HEFZJCU01CF619.17.10.A10.1.454.heavy.3.raw
  modified_base (460)..(460): a, c, t, g, unknown or other
  modified_base (485)..(485): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaatttgggtgcgacaggcccccggacaagggcttgagtgggtgggtgggtcagcggctttgacggtaaggcacagtatgcaccgaagatgaagggcagagtcacgattaccacggacacccccagaacacagtctacatgcaactgacgagcctggagagctgacgacacggccgtctattactgtgcgagaattgttttntgtcatcgtactaagtttgataggntctatggactggacttcgtac

SEQ ID NO: 529654 - DNA, 497 bp, Homo sapiens
  misc_feature: HEFZJCU01AFOCF.53.50.E06.1.454.heavy.3.raw
  modified_base (437)..(437): a, c, t, g, unknown or other
cgcgtatacacacgaccggtgctcgatttagatctactgacaacacacaagggggggagaggagcccagcactagaagtcggcggtgtttccattcggtgatcagcactgaacacagaggactcaccatggagtttgggctgagctgggtcttcctcgttgctcttttaagaggtgtccagtgccaggtgcagttggtggagtctgggggaggcgtggtccagcctgggcggtccctgagactctcctgtgcagcctctggattcaccttcagagtctatggcatgaactgggtccgccaggctccaggcaaggggctggagtgggtggcacttatactagatgatggaagtaataaatattatgcagactccgtgaagggccgagttcaccatctccagagacaattccaagaacactctgtatctgcaaatgaanagcctgagacctgaggacacggctgtctactactgtgcgaacggtctgagtgggaggttt

SEQ ID NO: 529655 - DNA, 521 bp, Homo sapiens
  misc_feature: HEFZJCU01EIJN6.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtcgtggggccaaggggacccacgggtccaccgtcctcctcacgcctcccaccgacgggcccagttccc

SEQ ID NO: 529656 - DNA, 537 bp, Homo sapiens
  misc_feature: HEFZJCU01BB781.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtctagtggaattgactactggggccgacggggaaccctggtccaccgtcctcctccagccctccaccaa

SEQ ID NO: 529657 - DNA, 513 bp, Homo sapiens
  misc_feature: HEFZJCU01ET44X.53.57.F02.1.454.heavy.3.raw
cgcgtatacacacgaccggtgctcgatttagctcgatatagttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggcctccaggcaaggggctgggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaccggtaaccccgtcgcac

SEQ ID NO: 529658 - DNA, 515 bp, Homo sapiens
  misc_feature: HEFZJCU01C355B.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtagtattttctggtcgcaaggagatacaactggtggggaaccgctttaatttcgaggtctc

SEQ ID NO: 529659 - DNA, 521 bp, Homo sapiens; identical to SEQ ID NO: 462357
  misc_feature: HEFZJCU01ELNCZ.2.81.H04.1.454.heavy.3.raw

SEQ ID NO: 529660 - DNA, 380 bp, Homo sapiens
  misc_feature: HEFZJCU01AQ7RS.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtccaaggactacttcctacgtgagct

SEQ ID NO: 529661 - DNA, 510 bp, Homo sapiens
  misc_feature: HEFZJCU01CO9H1.11.13.B02.1.454.heavy.3.raw
  modified_base (258)..(258): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacgggctgtgtattactgtgggagtccctggctggcacctgtatccgaccgttggagtcagggaactctggtcaccgtctcctcagcctccaccaagggcccatcggtcttcccctggcgccctcgctccaggagcacctccgagagcacagcggccc

SEQ ID NO: 529662 - DNA, 494 bp, Homo sapiens
  misc_feature: HEFZJCU01BNYHS.48.59.F04.1.454.heavy.3.raw
  modified_base (461)..(461): a, c, t, g, unknown or other
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagcttctgtgaccgccgcagacacggctgtctattactgtgcgaggccccgagcgcagtggnttttgatgccttgtatatgtgggcgaacgggac

SEQ ID NO: 529663 - DNA, 510 bp, Homo sapiens
  misc_feature: HEFZJCU01C2BM4.53.19.B08.1.454.heavy.3.raw
cgcgtatacacacgaccggtgctcgatttagtgagtcagtaaggggtctgggagacgagcccagcactggaagtcgccggtgtttccattcggtgatcatcactgaacacagaggactcaccatggagtttgggctgacctgggttttcttcgttgctcttttaagaggtgtccagtgtcaggtgcagctggtggagtcggggggaggcgtggtccagcctgggaagtccctgagactctcctgtgcggcctctggattcagtttcagttggtacggcatgcactgggtccgtcaggctccaggcaaggggctggagtgggtggcaattatatcgtatgatggaaccaaaagaactacgcagactccgtgaagggccgcttcagtatctccagagacgatcgccgggacaccctttatttgcaaatgagcagcctgagagttggagacacggctgtatattactgtgcgagagaccaaacctgaatatagcactggctggcagggcctta

SEQ ID NO: 529664 - DNA, 515 bp, Homo sapiens
  misc_feature: HEFZJCU01A6JZA.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcacatctccagagacaattccaggaacacaatgtatttggaatgaacagcctaagtcctgaggacgacgggtgtatacttactgtacgaagggaggggggaaccgaggcgggagtccaagtac

SEQ ID NO: 529665 - DNA, 540 bp, Homo sapiens
  misc_feature: HEFZJCU01A1X0U.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagccctgagaccagacgacacgggctgtctattattgcgcgagagagacacacgaaccctactggccaatacctatgggggcttgttcttgggggccagggggaccctggtcagtcgtctccccagccctccaccaagggccccatccggtcttccccctggccgccctcg

SEQ ID NO: 529666 - DNA, 524 bp, Homo sapiens
  misc_feature: HEFZJCU01CTRWM.13.36.D03.1.454.heavy.3.raw
tcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatgcccagggcttcacaggacggtttgtcttctcccttggacacctctgtcagcacggcgtatgtacagatcagcagcctaaaggctgaggacactgccatttattactgtgtgagagatttctttccttgtactacggttacttctgtccttggacttacgtggggtccagggtaacccg

SEQ ID NO: 529667 - DNA, 518 bp, Homo sapiens
  misc_feature: HEFZJCU01B10AS.8.34.D01.1.454.heavy.3.raw
ctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagactaagtcctgagacacgggcgtatactactagtacgaagggaggggggaaccagacgggagttccaagtacttcctttgactcgg

SEQ ID NO: 529668 - DNA, 516 bp, Homo sapiens
  misc_feature: HEFZJCU01ECOOT.48.70.G04.1.454.heavy.3.raw
agtatacatacacgaccggtgctcgatttagtgtagtgtgaagggaaagggggctctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcaggtattagttggaatagtgatagcataggctatgtggactctgtgaagggccgattcaccatctccagagacaacgccaagaactccctgtatctgcaaatgaacagtctgagaactgaggacacggccttgtattactgtagtaaaagatatgtagtttttggggttcggggagtttgga

SEQ ID NO: 529669 - DNA, 497 bp, Homo sapiens
  misc_feature: HEFZJCU01ASHJ3.48.53.E09.1.454.heavy.3.raw
agtatacatacacgaccggtgctcgatttagagagagtgtgttgggtttgggggctctgggagaggagccccagccctgagattcccaggtgtttccattcagtgatcagcactgaacacagaggactcaccatggagttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatcctccagagacaacgccaagaactccctgtatctgacaaatgaacagtctgacgacctggaggacacggcctttctattactgtgcaaaagatcaggca

SEQ ID NO: 529670 - DNA, 506 bp, Homo sapiens
  misc_feature: HEFZJCU01CMP5N.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctacccagtggtggcacaaagtttgcgcagaagtttcagggcagggtcaccatgaccagggacacgtccatcagcactgcctacatggagctgaccaggctgaaatttgaggtacacggccatttattactcgttgcaaggaacagcgataatgactccgtcccccggtacctttcg

SEQ ID NO: 529671 - DNA, 525 bp, Homo sapiens
  misc_feature: HEFZJCU01D7RAZ.52.37.D04.1.454.heavy.3.raw
cgcagtacgacacgaccggtgctcgatttagtagcatactgttgggtttggggtctctgagagaggaggccagccctgggattttcaggtgttttcatttggtgatcaggactgaacagagagaactcaccatggagtttgggctgagctggctctttcttgtggctattttaaaaggtgtccagtgtgacgtacagctggtggagtcggggggagccttccaacacccggggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggaccacggccgtttattactgtgcgaaagatcgaggtcgcatgacagttttggagtggcaagacggacg

SEQ ID NO: 529672 - DNA, 399 bp, Homo sapiens
  misc_feature: HEFZJCU01EHVRC.16.29.C07.1.454.heavy.3.raw
tgtactactccacgaccggtgctcgatttagagtgctacgaagggaaaggggctggagtgggtctcagctattagtattagtggtgatagcacatactacgcagactccgtgaagggccggttcaccatctccagagacaattccaagaatatgttgtatctgcaaatgaacagcctgagagccgaggacacggccgtatattactgtgcgaagatgtaaagtgggcgctactagactcgggggcttttgatatctggggccaagggacaatggtcaccgtctcttcagcctccaccaagggcccatcggtcttccccctggcaccctcctccaagagcacctctgggggcacagcggccctgggctgcctggtcaagggactacttccgagtagtaca

SEQ ID NO: 529673 - DNA, 532 bp, Homo sapiens
  misc_feature: HEFZJCU01ANQGY.48.57.F02.1.454.heavy.3.raw
agtatacatacacgaccggtgctcgatttagctcgatatagttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaactatgcacagaagctaccagggcagagtcaccatgaccacagacacatccacgagcacacgcctacatggagctgaggagcctgagatactgacgacacggccgtgtacttactgtgcggagaggtaagggttttactagttgggttcgggggtagtccgtcccgtacccaggcctaacgttcgggttacccg

SEQ ID NO: 529674 - DNA, 480 bp, Homo sapiens
  misc_feature: HEFZJCU01AX9OU.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccagacgtatc

SEQ ID NO: 529675 - DNA, 496 bp, Homo sapiens
  misc_feature: HEFZJCU01A1RBN.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatggggactcatgaacaatatgcagactccgtgaagggccgattcatcatctccagagacaactccaacaacacactggatctccaaatgaacagcctgagagtcgaggaccaacggccgttataacttattgtgtcccttagatttacta

SEQ ID NO: 529676 - DNA, 517 bp, Homo sapiens
  misc_feature: HEFZJCU01EPXD7.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtacgcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactccaccttcggcttggacatctggggccgac

SEQ ID NO: 529677 - DNA, 430 bp, Homo sapiens; identical to SEQ ID NO: 477696
  misc_feature: HEFZJCU01BITYZ.4.37.D04.1.454.heavy.3.raw

SEQ ID NO: 529678 - DNA, 526 bp, Homo sapiens
  misc_feature: HEFZJCU01ENE14.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagatggggcccacgaacgttactacgctatggacgtcgtggggccgaagggaccgtacc

SEQ ID NO: 529679 - DNA, 499 bp, Homo sapiens
  misc_feature: HEFZJCU01CH6P0.40.1.A01.1.454.heavy.3.raw
tctagcgactcacgaccggtgctcgatttagacgtctcatcaggggctgggagacgagcccagcactggaagtcgccggtgtttccattcggtgatcagcactgaacacagaggactcaccatggagtttgggctgacctgggtttttcctcgttgctcttttaagaggtgtccagtgtcaggtgcagctggtggagtctgggggaggcgtggtccagcctgggaggtccctgagactctcctgtgcagcctctggattcattttcagtaactatgctatgcactgggtccgccagactccgggcaaggggctggagtgggtggcaattatctcatatgatgaaagtcaagaatactacgcagactccgtgaagggccgattcaccatctccagagacaattccaagaacacactgaatctacaaatgaacagcctcagaccttggaggactcggctgtctatttctgtgcgaggagggggtgactatcgatcctttgt

SEQ ID NO: 529680 - DNA, 524 bp, Homo sapiens
  misc_feature: HEFZJCU01D0QY5.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcgtggggccaggggaccctggtcatcgtctccccagcctccaccaaggcccatcggtccttcccctcggccg

SEQ ID NO: 529681 - DNA, 393 bp, Homo sapiens
  misc_feature: HEFZJCU01BEDNI.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttccccctggcaccctcctccaagagcacctctgggggacacagcggccctgggctgcctggtcaaggactacttccgagtagtaca

SEQ ID NO: 529682 - DNA, 517 bp, Homo sapiens
  misc_feature: HEFZJCU01DNTU7.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgaggcagtgttcaatggtatgcagactccgtgaagggccgattcaccatctccagagacaattccaggaacacaatagtatttggagctgaacagcctaagtcctgaggacacgggcgtatactactgtacgaagggaaggggggaaccgagacggggagttccgaagtactacctttg

SEQ ID NO: 529683 - DNA, 495 bp, Homo sapiens
  misc_feature: HEFZJCU01CEB7V.53.73.G07.1.454.heavy.3.raw
cgcgtatacacacgaccggtgctcgatttagctctacgctcagggggcatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctggggcctcagtgatgatttcctgcacgacatctggatacaccttcaccgactcccttatacattgggtacgacaggccccctggacaggggcttgagtggatgggtctaatcaaccctagtggtggatctacaagttactcacagagaatgcagggccgaaattaccatgaccagagacacgtccacgagtacagtctacatggaggtgagcagcctgagatctgaggacacggccatgtatttactggttgcgatcgttagtggattacgactacaatattttgtcacg

SEQ ID NO: 529684 - DNA, 525 bp, Homo sapiens
  misc_feature: HEFZJCU01BOQXB.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcacttttatcttgcaaatgaacagcctgagaacccgacgacacggccgtctatttattgtgtcatacgacctaggatacgaacgacggtggtacctgggtattc

SEQ ID NO: 529685 - DNA, 522 bp, Homo sapiens
  misc_feature: HEFZJCU01BIEP7.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagaggccgaggacacggctcgtgtattactgtgtgagagattgttctgcgttgggggccaggggaccctggtacaccg

SEQ ID NO: 529686 - DNA, 491 bp, Homo sapiens
  misc_feature: HEFZJCU01ECEQV.40.22.B11.1.454.heavy.3.raw
tctagcgactcacgaccggtgctcgatttagacgacagctcagggggctctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctaac

SEQ ID NO: 529687 - DNA, 491 bp, Homo sapiens; identical to SEQ ID NO: 446104
  misc_feature: HEFZJCU01BDI5F.3.34.D01.1.454.heavy.3.raw

SEQ ID NO: 529688 - DNA, 316 bp, Homo sapiens; identical to SEQ ID NO: 444444
  misc_feature: HEFZJCU01D986O.47.56.F01.1.454.heavy.3.raw

SEQ ID NO: 529689 - DNA, 515 bp, Homo sapiens
  misc_feature: HEFZJCU01BQ9L6.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggagcttggtccagccagggcggtccctgagactctcctgtacagcgtctggattcaactttcgtgattatgccatgaactgggtccgccaggctccgagggaaggggctgggagtgggtaggtttcattagagccatggcttatgctgggacaacagaatacgccgcgtctgtgaaggcagattcatcatctcaagagatgattccaacggcatcgcctatctgcagatgaacagcctgaagaccggaggacacagccgtctattactgtggttagggtagttttacggtatttttggta

SEQ ID NO: 529690 - DNA, 525 bp, Homo sapiens
  misc_feature: HEFZJCU01EJVYY.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcagtcgtctccccagccctccaccaagggcccatcggtcttccccctggccg

SEQ ID NO: 529691 - DNA, 515 bp, Homo sapiens
  misc_feature: HEFZJCU01C4U2T.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacgacggctatctattactgtgcgaaactctcattccgttcatctagaatactggggccagggaacccctggtccgtccg

SEQ ID NO: 529692 - DNA, 518 bp, Homo sapiens
  misc_feature: HEFZJCU01BT32C.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagtagtttatggcgaagtggctgggtggacagatcactggggccaac

SEQ ID NO: 529693 - DNA, 522 bp, Homo sapiens
  misc_feature: HEFZJCU01BKBTM.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagaggcacacgcggcccctcgggccgtcg

SEQ ID NO: 529694 - DNA, 519 bp, Homo sapiens
  misc_feature: HEFZJCU01CVG55.14.85.H08.1.454.heavy.3.raw
  modified_base (497)..(497): a, c, t, g, unknown or other
cgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaaggggctggagtggattgggggaaatcagtcaaagtggaggcaccaagtacaacccgtccctcgagagtcgagtcaccatatcaatagacacgttccagaatcagttctccctgaggctgacttctgtgacagccgcggacacggctgtgtattactgtgcgagatctttcggctggtacgctcttgactacgtcgggcgacggaaccgtcggtcaccgtctcttcncgtcctccaaccgaacggcccg

SEQ ID NO: 529695 - DNA, 482 bp, Homo sapiens
  misc_feature: HEFZJCU01ADKNE.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaaggccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaacgaaccaagttctccctcgcagctgacctctgtgactcccgaggacacgggtgtatattactgtggaaggacggcccca

SEQ ID NO: 529696 - DNA, 527 bp, Homo sapiens
  misc_feature: HEFZJCU01DGM25.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatccgacatctgacgacacggccatatattactgtgcgagaaggacggtttttggggcgcggactcctctttgagatctggggccagggggacaagtggtcaccgtctcttcagcct

SEQ ID NO: 529697 - DNA, 529 bp, Homo sapiens
  misc_feature: HEFZJCU01A1PB4.51.62.F07.1.454.heavy.3.raw
  modified_base (252)..(252): a, c, t, g, unknown or other
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacntcttaagaagttatgacatcgcctgggtgcgacaggcccctggacatgggcttgagtgggtgggcaggatcatccctatgtttggagtcgcaaactacgcacagaagttccgggcaaagtcacgttgaccgcggacacagtcacggacacagcctacatggaactcgaacggcctcagatttgaggacacggccgtctattattgtgcgagagtgagaaattacggtggctactcccttgactactgggggccaggggaacccctggtacgtacccg

SEQ ID NO: 529698 - DNA, 544 bp, Homo sapiens
  misc_feature: HEFZJCU01C23ZC.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagtagatccggcccataactggctcggccctggggcccggaacccgtggtcaccgtctcctcgacgcctccaccaacgggcccagtccggtccgtttcccccgtcgggccctacccctccc

SEQ ID NO: 529699 - DNA, 517 bp, Homo sapiens
  misc_feature: HEFZJCU01DU8B9.40.31.C09.1.454.heavy.3.raw
tctagcgactcacgaccggtgctcgatttagacgtctcatcaaggaaggaagggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcacgtggtcttttgattgtctttgatatggtggggaccgaagggaacaagtcggtctacccg

SEQ ID NO: 529700 - DNA, 497 bp, Homo sapiens
  misc_feature: HEFZJCU01BOGHV.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgtactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgacgtacgggggcgtc

SEQ ID NO: 529701 - DNA, 542 bp, Homo sapiens
  misc_feature: HEFZJCU01CBYTL.13.28.C06.1.454.heavy.3.raw
  modified_base (490)..(490): a, c, t, g, unknown or other
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccattcaccatctcgagggacaacgccaagaactcgctgtatctgcaaatggagagcctgagagccgaggacgacggctgtatattattgtgtgagatttaggcncgacttacttgacctacgttgggggccaggggaacccctgggtccaccggtt

SEQ ID NO: 529702 - DNA, 483 bp, Homo sapiens
  misc_feature: HEFZJCU01D5Z4K.4.37.D04.1.454.heavy.3.raw
  modified_base (473)..(473): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatgtatcgaccctaacagcggtggcacaaagtatgcacagaagtttcagggcaggggtcaccaatgaccagggacacgtccatcagcacgtccatcagcacagcctaacatggacctgagcggcctgacatctgacgacacggccgtatactttntgtgcgaggg

SEQ ID NO: 529703 - DNA, 487 bp, Homo sapiens; identical to SEQ ID NO: 447190
  misc_feature: HEFZJCU01C56K9.3.48.E04.1.454.heavy.3.raw

SEQ ID NO: 529704 - DNA, 536 bp, Homo sapiens
  misc_feature: HEFZJCU01AN0O6.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctgggtcatcgtctccccgagcctccaccgaagggccccagtccggtcttccccctggccgcccgtcg

SEQ ID NO: 529705 - DNA, 491 bp, Homo sapiens; identical to SEQ ID NO: 444749
  misc_feature: HEFZJCU01EB2RQ.11.13.B02.1.454.heavy.3.raw

SEQ ID NO: 529706 - DNA, 501 bp, Homo sapiens
  misc_feature: HEFZJCU01BL6BB.17.10.A10.1.454.heavy.3.raw
  modified_base (459)..(459): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtggtcagcggcttgacggtaaggcacagtatgcaccgaagatgaagggcagagtcacgattaccacggacacccccacgaaccacagtctacatgcaactgacgagcctgagagctgacgacacggccgtctattactgtgcgagaatgttttcngtcatcgtacaatttgataggctctatggactggacttcgtc

SEQ ID NO: 529707 - DNA, 491 bp, Homo sapiens; identical to SEQ ID NO: 490157
  misc_feature: HEFZJCU01B2W7B.22.86.H09.1.454.heavy.3.raw

SEQ ID NO: 529708 - DNA, 509 bp, Homo sapiens
  misc_feature: HEFZJCU01DLNCT.48.44.D11.1.454.heavy.3.raw
agtatacatacacgaccggtgctcgatttagcgcagtacgaagggaaaggggagctctgggagaggagccccagccctgagaatcccaggtgtttccattcagtgatcagcactgaacacagaggactcaccatggagttgggactgagctggattttccttttgactattttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggtacg

SEQ ID NO: 529709 - DNA, 518 bp, Homo sapiens; identical to SEQ ID NO: 445453
  misc_feature: HEFZJCU01ENXNA.9.34.D01.1.454.heavy.3.raw

SEQ ID NO: 529710 - DNA, 561 bp, Homo sapiens
  misc_feature: HEFZJCU01C3NE0.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtgggtggtaccacatactacacagacctccggtgaagggccgattcaccatctcagaagacaattccaggaacacattgtatcttcaaatgaataacctgagagccgaggaccacggccatgtatttactgtggtgggggctattttacttcgaccccgtcgggggacccgggggaacccgttcgggtccgacccggtcctcccccaacccctccccaacccg

SEQ ID NO: 529711 - DNA, 531 bp, Homo sapiens
  misc_feature: HEFZJCU01B6TH2.47.46.E02.1.454.heavy.3.raw
  modified_base (505)..(505): a, c, t, g, unknown or other
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaaggggctggagtgggtctcaagtattgatgagaatgggtggaagcacattctacgtggactccgtgaagggccggttcaccatctccagagacaatttcaggagcacgctgtatctacaaatgaacagcctgagagccgagacacggccgtatatttctgtgcgaaagtctatagcagtcgccccctacgcgaccnctttctttgactttcgtggggccgaa

SEQ ID NO: 529712 - DNA, 507 bp, Homo sapiens
  misc_feature: HEFZJCU01C8JEC.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaatgaacagcctgacagtcgacgacaccggccatgtatttttgtgcgagcgacccggggctccgtcaatggcttcattacg

SEQ ID NO: 529713 - DNA, 519 bp, Homo sapiens
  misc_feature: HEFZJCU01DVP89.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccgggatattgttatagaaccacctgctatctgagcttggttcgactgcgtggggccaaggggaaccctgggtcctaccg

SEQ ID NO: 529714 - DNA, 513 bp, Homo sapiens
  misc_feature: HEFZJCU01B1RM7.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacggcggccgtatattactgtgcgagagtacgtagcggctcgtctttgactactggggcctgggaactctggtcaccgtct

SEQ ID NO: 529715 - DNA, 519 bp, Homo sapiens
  misc_feature: HEFZJCU01AJNEY.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggccaccctcctccaagagcacctctgggggcacagcggcctgggctgcctggtcaaggactacttccagacgtatca

SEQ ID NO: 529716 - DNA, 518 bp, Homo sapiens
  misc_feature: HEFZJCU01EJVZX.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggcctccgagggaaggggctggagtgggtctcagttattgaaacagatggcactacatattattctgactccgtgaaggggccggttcaccctctccagagacacttccaacaacatcttgtatcttcacatgcacaatctgagagtcgacggacacggccacctattattgtgcgcgacatgactacgacctcaattccgtcggggccgaggggtacg

SEQ ID NO: 529717 - DNA, 521 bp, Homo sapiens
  misc_feature: HEFZJCU01DKDAL.16.35.D02.1.454.heavy.3.raw
  modified_base (452)..(452): a, c, t, g, unknown or other
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtgcgcagcctggaggcctcggacaccgccatatattactgtncgagtccggttatcgccgcagatcactactactactaccggtctggacgtctgggggccaaggggaccg

SEQ ID NO: 529718 - DNA, 492 bp, Homo sapiens
  misc_feature: HEFZJCU01BO49C.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagacgagttgacgagt

SEQ ID NO: 529719 - DNA, 504 bp, Homo sapiens
  misc_feature: HEFZJCU01AKSSW.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcacctttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaatttagtaggacacggccatttattactgttgcaaggaacagcataatagactcgtcccccggtactttacg

SEQ ID NO: 529720 - DNA, 492 bp, Homo sapiens
  misc_feature: HEFZJCU01EZN86.52.19.B08.1.454.heavy.3.raw
cgcagtacgacacgaccggtgctcgatttagtgagtcagtaagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactggggtccgccagctccaggcaaggggctggagtgggtggcatttatatcatatgatggaagcaaagatatactatgtagactccgtagaagggccgattcatcatctccagagacaactccgagaacacgctgtatctgcaaatgatcaggctagagagctagaagacacggtctttatattactgtgacgtaacttaatacgac

SEQ ID NO: 529721 - DNA, 518 bp, Homo sapiens; identical to SEQ ID NO: 444718
  misc_feature: HEFZJCU01BQT81.9.34.D01.1.454.heavy.3.raw

SEQ ID NO: 529722 - DNA, 496 bp, Homo sapiens
  misc_feature: HEFZJCU01EVQH9.22.86.H09.1.454.heavy.3.raw
  modified_base (491)..(491): a, c, t, g, unknown or other
acatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgngagag

SEQ ID NO: 529723 - DNA, 508 bp, Homo sapiens
  misc_feature: HEFZJCU01CNJXW.2.53.E09.1.454.heavy.3.raw
acgctcgacacacgaccggtgctcgatttagagagagtgtgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaattctgaagcccttcaatacagtgtggatgaattgggtccgccaggctccagggaaggggctggagtgggttggccatataaaagtagactgctggtgagacaacagactacgctgctgccttcagaggcagattcaccatcttcagagatgaatcacagagcactctgtttctgcaatgaacagcctggaagacgcggacacagccatgtattattgtacattaggacacgtatagtcccgtggggccgagggaacccctcc

SEQ ID NO: 529724 - DNA, 515 bp, Homo sapiens
  misc_feature: HEFZJCU01A8P0W.13.76.G10.1.454.heavy.3.raw
tcacgtactacacgaccggtgctcgatttagtcactcatacagggggggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtctggggccaagggaccacggtcaccgtctcctca

SEQ ID NO: 529725 - DNA, 533 bp, Homo sapiens
  misc_feature: HEFZJCU01D1SVY.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtggggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgcctgctccagagcacctccgacgagcacagcggccctcgggcgtgcctggtcaaggacgtaacttcctaacg

SEQ ID NO: 529726 - DNA, 534 bp, Homo sapiens
  misc_feature: HEFZJCU01B6I01.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaatactatacactgctcctttttacaccttcccttgtacttcgtcggggccagtcggaaccccggtccg

SEQ ID NO: 529727 - DNA, 527 bp, Homo sapiens
  misc_feature: HEFZJCU01C1UQ2.4.28.C06.1.454.heavy.3.raw
agcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccagggaaggggctggtctgggtctctcgtattgatagtgatggcagtaccaggaggatatgcggacgccgtgaggggccgattcaccatcttcagagacaacgccaaggacacgctgtatcgtggaaatgagcagtctgagagccgaggacacggcttgtgtattactgtgcaagagataacggcttggtaccgtccctttggactactcggggggccccgggtacccgtc

SEQ ID NO: 529728 - DNA, 500 bp, Homo sapiens
  misc_feature: HEFZJCU01EERTL.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctggagccctgacgacacggccatatatttctgtgcgcgaggaattcgacttctggaatattacttgggttggaactacc

SEQ ID NO: 529729 - DNA, 538 bp, Homo sapiens
  misc_feature: HEFZJCU01EH8CH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactaaccatggagttttggctgagcgtgggttttccttgttgctattttagaaggtgtccagtgtgaagtgcacctggtggagtccgggggagacgttggtccagcctgggggggtccctgagactctcctgtgtagcctctggatttgtttttagtgactattggatgagttgggtccgccaggctccagggaaggggctggagtggggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcactactttgactactggggccaggggaaccctggtcaccgtctcctcaacctccacc

SEQ ID NO: 529730 - DNA, 551 bp, Homo sapiens
  misc_feature: HEFZJCU01AMFR9.21.78.H01.1.454.heavy.3.raw
tcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggggtccctgagactctcctgtgcagtctctgggttcgtcagtggcgactacatgagctgggtccgccaggctccagggaaggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggctagtttactttcgacccctggggggcccgggggtaacccgtcggtccaccggtcctccccctacccctccccaccaaacc

SEQ ID NO: 529731 - DNA, 503 bp, Homo sapiens
  misc_feature: HEFZJCU01AY0DW.10.55.E11.1.454.heavy.3.raw
catagtagtgcacgaccggtgctcgatttagcactcgcacgttgggtttgggctcaactctcttgtccaccttggtgttactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagtcttttgtaattttggggccaagggacaagtggtcatcgtctcctcacg

SEQ ID NO: 529732 - DNA, 532 bp, Homo sapiens
  misc_feature: HEFZJCU01C0H94.17.34.D01.1.454.heavy.3.raw
  modified_base (409)..(409): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattggggtgcgacgggcctctggacaaggccttgagtggatgggaaggatcgtccctatcgttgacacaccaaactacgcacagaagttccagggcagactcaccataaccgcggacaaattaacgaacacagttaanctggagctgaacagcctgtcatctgaggacacgggcttctacttctgtgcgaggagtaattactataacactgctcttttacacctccctttgacttctggggccagtcggaaccccggtccg

SEQ ID NO: 529733 - DNA, 370 bp, Homo sapiens; identical to SEQ ID NO: 445884
  misc_feature: HEFZJCU01DZI88.3.42.D09.1.454.heavy.3.raw

SEQ ID NO: 529734 - DNA, 490 bp, Homo sapiens
  misc_feature: HEFZJCU01AQPZW.21.77.G11.1.454.heavy.3.raw
tcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttctatcatatgatggacgttataaatcctatgcggactccgtgaagggccgattcaccatctccagagacaattccaagaacacgctgtatctgcagatgaacagcctgagagcgtggggacacggctatcttattactgtgcgaaagtatatggggt

SEQ ID NO: 529735 - DNA, 496 bp, Homo sapiens
  misc_feature: HEFZJCU01BPNK8.49.48.E04.1.454.heavy.3.raw
agtcgagagacacgaccggtgctcgatttagagagcgtcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaacctagtggtggtagcacaacctccgcacagaggttccagggcagagtcaccatgaccagggacacgtccacgagcacattctaacatggaactgagccgcctgagatctagacgacacggccgtgtactatgtgcgagagtcactcaactttactacgatacgttatggta

SEQ ID NO: 529736 - DNA, 474 bp, Homo sapiens
  misc_feature: HEFZJCU01BRKAR.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccgagttctccctgcagctgacctctgtgactcccgaggacgacgggtgtatattactcgtggtaaga

SEQ ID NO: 529737 - DNA, 490 bp, Homo sapiens
  misc_feature: HEFZJCU01A698L.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaacagcctgcgagccgaggacacggctgtgtattactgtgggagtcctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaggactacttcgtatctctcg

SEQ ID NO: 529738 - DNA, 512 bp, Homo sapiens
  misc_feature: HEFZJCU01A5CW0.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatgggttactactggagttgggtccggcagtccccaacacagggactgcagtggattggatacatctacttcagtgggaaccccaactacaacccctccctcaggattccagtcgccatatccctggactcgtccaacaaccagatctccctgacgatgacatctgtgaccgctgcggacacagccgtttattactgtgcgcgatctgggcgactcagtgactatggtatggacgtctgggggccaagggaccacggtcatcgtctcctcagcctccaccaacgggcccatcggtcttcccctgg

SEQ ID NO: 529739 - DNA, 508 bp, Homo sapiens
  misc_feature: HEFZJCU01B6R89.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggacctggtcgccg

SEQ ID NO: 529740 - DNA, 506 bp, Homo sapiens
  misc_feature: HEFZJCU01EA9H5.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctgaaagaccgaggacacagccgtctatactgtgttagggtagtttgcgtagtttt

SEQ ID NO: 529741 - DNA, 523 bp, Homo sapiens; identical to SEQ ID NO: 460004
  misc_feature: HEFZJCU01BOUET.5.33.C11.1.454.heavy.3.raw

SEQ ID NO: 529742 - DNA, 509 bp, Homo sapiens
  misc_feature: HEFZJCU01D9Q2N.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgaacatctgacgacacggccgtctattactgtgcgagagtcccacgactccggtgagcctacgggcaggcggccctttgacttcgtc

SEQ ID NO: 529743 - DNA, 523 bp, Homo sapiens
  misc_feature: HEFZJCU01BFBJ3.12.1.A01.1.454.heavy.3.raw
  modified_base (445)..(445): a, c, t, g, unknown or other
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctggaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacngccaagacagtattttggagtggttactggttggacttaactttgactacgtcggggccacggggaaccctgggtccg

SEQ ID NO: 529744 - DNA, 512 bp, Homo sapiens
  misc_feature: HEFZJCU01BMJVF.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccaatgaccacagacacatcagcgaacacagtcaacatggagttgcggagcctgcgatctgacgacgcggccgtatattactgtgcgagagtacgtagcggctcgtctttgactactgggcctgggaactcgtgtcacgtcct

SEQ ID NO: 529745 - DNA, 448 bp, Homo sapiens
  misc_feature: HEFZJCU01EWPUC.51.82.H05.1.454.heavy.3.raw
  modified_base (442)..(442): a, c, t, g, unknown or other
cgatcgtatacacgaccggtgctcgatttagtcgagctctctcgcgggtctctgggagaggagcccagccctagaagtcggcggtgtttccattcggtgatcagcactgaacacagaggactcaccatggagtttgggctgagctgggttttcctcgttgctcttttaagaggtgtccagtgtcaagtgcaactggtggagtctgggggaggcgtggtccagcctgggaggtccctgagactctcctgcgtggcctctgattcaccttcaatagttatggcatggctctgggtccggccagggccccaggcaagggggctggactgggtagcatctatatcgtacgatggagtctgacgatacctcgcagactccgtgaagggccggattcaccatctcaagagacaattcaaggaacaaccctggtttctgctaatgaacngcctga

SEQ ID NO: 529746 - DNA, 530 bp, Homo sapiens
  misc_feature: HEFZJCU01AKSIO.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgagcgcaatctatctggaactgagccgcctgacatctgcagactcgggcagtatatttctgtgcgagagaggggaggagtggttggaggggaattggttaattcctatacttaacctttggaccactcgggggccacggggtaaccccg

SEQ ID NO: 529747 - DNA, 503 bp, Homo sapiens
  misc_feature: HEFZJCU01BPUD0.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagccgtacggcagcggcctttgcttctc

SEQ ID NO: 529748 - DNA, 410 bp, Homo sapiens; identical to SEQ ID NO: 455592
  misc_feature: HEFZJCU01DXUQZ.52.35.D02.1.454.heavy.3.raw

SEQ ID NO: 529749 - DNA, 368 bp, Homo sapiens
  misc_feature: HEFZJCU01DGXZX.3.1.A01.1.454.heavy.3.raw
agacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcgctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgagtgcgt

SEQ ID NO: 529750 - DNA, 486 bp, Homo sapiens
  misc_feature: HEFZJCU01EMV8B.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaaggatacggctatttactattgtgcgcgatcgacagaaaa

SEQ ID NO: 529751 - DNA, 513 bp, Homo sapiens
  misc_feature: HEFZJCU01D50NP.51.31.C09.1.454.heavy.3.raw
cgatcgtatacacgaccggtgctcgatttagacgtctcatcaaggaaggaaggggagctctgagagaggagcccagccctgggattttcaggtgttttcatgtggtgatcaggactgaacagagagaactcaccatggagtctgggctgacgtgactttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcaatgatcagtgatggtggaacgaccacaaactacgccgactccgtgaagggccggtgcaccatctccagagacaattcgaaggacactttatatctgcaactcaacagactgacaccgcgacacggccgtctactactgtgtagaaagaagacggaccgctggacgaggagccaga

SEQ ID NO: 529752 - DNA, 515 bp, Homo sapiens
  misc_feature: HEFZJCU01A3DNJ.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccgagggaaggggctggagtgggtggccaacataaacaaagacggaagtcaagaaaaactatgtggactctgtgaacggccgattcaccatctccagagacaacgccaagaattcactgtatttgacaaatgaacagcctgagaggcgaggacacggccgtgtattattgtgcgcgagatgatagtagactctacagtagcaggtggta

SEQ ID NO: 529753 - DNA, 497 bp, Homo sapiens
  misc_feature: HEFZJCU01EJOT2.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggaccacggctgtgtattactgtggagagatggaggtcgatagttgta

SEQ ID NO: 529754 - DNA, 501 bp, Homo sapiens; identical to SEQ ID NO: 482763
  misc_feature: HEFZJCU01BY55T.17.10.A10.1.454.heavy.3.raw

SEQ ID NO: 529755 - DNA, 485 bp, Homo sapiens; identical to SEQ ID NO: 475599
  misc_feature: HEFZJCU01C6SJI.12.75.G09.1.454.heavy.3.raw

SEQ ID NO: 529756 - DNA, 509 bp, Homo sapiens
  misc_feature: HEFZJCU01BTR2W.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcaactggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggtcctttgacttctgggggccagggga

SEQ ID NO: 529757 - DNA, 501 bp, Homo sapiens
  misc_feature: HEFZJCU01ANVEB.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagcctggggggtccctgagactctcctgcgcagcctctggattcaccttcagtagttatagcatgaactgggtccgccaggctccagggaagggctggagtgggtctcatccattagtagtaatagtgcctacagatactacgcagactcactgaagggccgactcaccatctccagagacaacgccaagaactcactgtatctgcaaatgaacagacctgagagccgaggacacggctgtgtattactgtgcgagaggagactattatctggaccccgat

SEQ ID NO: 529758 - DNA, 363 bp, Homo sapiens
  misc_feature: HEFZJCU01BKQK2.10.44.D11.1.454.heavy.3.raw
catagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggagcacctccgagagcacagcggccctgggctgcctggtcaaggactacttcccactactatg

SEQ ID NO: 529759 - DNA, 515 bp, Homo sapiens
  misc_feature: HEFZJCU01EECVE.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctggggctcgccaggctccagggaaggggctggagtgggtctctgctattcctggcagtggtgatatcgaatactacgcagactccgtgaagggccggttcactgtttccagagacaattccaagaacacaactgtatctgcagatgaccagcctgagagccgaggacacgggccgtatattactggtgacgaaacgccaagtatttttaggagtggttattactacctttgacttcgg

SEQ ID NO: 529760 - DNA, 496 bp, Homo sapiens
  misc_feature: HEFZJCU01EK6GM.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaagatttctatagaggtgacgtacggggcgttc

SEQ ID NO: 529761 - DNA, 524 bp, Homo sapiens
  misc_feature: HEFZJCU01EOCED.22.41.D08.1.454.heavy.3.raw
acatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttctaagggaaacacaaactatgcagagaggctccagggcagagtcaccatagaccgcagacacaccaacgaccacagcctacatcggagttgaggagtctgagacctgacgacacggccgtatattactgcgcgagagggcgtttctacggtgactatgagtatctcaggcacgtggggccaggggcacccgtggtctacg

SEQ ID NO: 529762 - DNA, 477 bp, Homo sapiens; identical to SEQ ID NO: 444659
  misc_feature: HEFZJCU01BP4WY.16.10.A10.1.454.heavy.3.raw

SEQ ID NO: 529763 - DNA, 514 bp, Homo sapiens
  misc_feature: HEFZJCU01CRI5J.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactccctccataaacacagcctacatggagttgaggagcctgacatctgacgacacggccgtctattactgtgcggagacggtcccacgatccggtgagccctacggcaggccggtcctttgacctttcgtc

SEQ ID NO: 529764 - DNA, 526 bp, Homo sapiens
  misc_feature: HEFZJCU01DQAEB.16.27.C05.1.454.heavy.3.raw
  modified_base (488)..(488): a, c, t, g, unknown or other
  modified_base (518)..(518): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtggtggcgttatttcatatgatggaactactcaacactatccagactccggggagggccgattcaccgtctccagagacaattccaagaacagggtgtttctccaagtgattgatctgagaagtgaggacacggctgtttattactgtgcggcggtggctgaccgctnttgactactgggggccggggagccccggtnactcgtct

SEQ ID NO: 529765 - DNA, 513 bp, Homo sapiens
  misc_feature: HEFZJCU01DTP9U.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccggtatatttctgcgcgagagacgtaaaagtagacgtggtagttccggggggtacgacatgactaccgg

SEQ ID NO: 529766 - DNA, 512 bp, Homo sapiens
  misc_feature: HEFZJCU01DEASF.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgacttactggggccagggaactctgtcaccgtctccgcagcctcaccaagggccc

SEQ ID NO: 529767 - DNA, 528 bp, Homo sapiens
  misc_feature: HEFZJCU01EH5RD.48.81.H04.1.454.heavy.3.raw
agtatacatacacgaccggtgctcgatttagtagtgtagattcgcgggaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcgggggaggtggacggagctcggttttcggagttatcatctactactttgaatcgttggggcccgggaacccgtggtcctaccg

SEQ ID NO: 529768 - DNA, 506 bp, Homo sapiens
  misc_feature: HEFZJCU01BN992.53.29.C07.1.454.heavy.3.raw
  modified_base (485)..(485): a, c, t, g, unknown or other
cgcgtatacacacgaccggtgctcgatttagagtgctacgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaaggctaggaaactttgaaggacgacggcccattttattactgtgcaaggaacagcataatnactcgtccccggactttgtac

SEQ ID NO: 529769 - DNA, 530 bp, Homo sapiens
  misc_feature: HEFZJCU01B71VI.12.11.A11.1.454.heavy.3.raw
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgcaggctccagggaagggctggagtgggtggccaacataaagcaagatggaagtgagaaatactatgtggactctgtgaaggccgattcacaatctccagagacaacgccaagaactcactgtatctgcaaataacagcctgaaagccgaggacacggctgtgtattttctgtgcgaggacgtccgtacggtgaacgtaaattttacgttacaaaaccgagaacaaaagttttccg

SEQ ID NO: 529770 - DNA, 498 bp, Homo sapiens
  misc_feature: HEFZJCU01EDL4L.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagaccttaccatcgaccacgaactcctccataaacacacgcctacatggagttgaggagcctgacatctgacgacacggccgtctattactgtgcgagacgtcccacgatccggtgacgcctaggcagcgctttg

SEQ ID NO: 529771 - DNA, 506 bp, Homo sapiens
  misc_feature: HEFZJCU01BAN7M.5.31.C09.1.454.heavy.3.raw
atcagacacgcacgaccggtgctcgatttagacgtctcatcaaggaaggaagggggctctgggagaggagccccagccctgagattcccaggtgtttccattcggtgatcagcactgaacacagagaacgcaccatggagtttggactgacctgggttctccttgttgctattttaaaaggtgtccagtgtgcagtgcagctggtgcagtcggggggagtcgtggtgcagcctggggggtccctgacactctcctgtgaagcctctggattcacgttcgatgattataccatgcactgggtccgtcaagttccgggaccggtctagagtgggtcgcttttatcagttgggatggtggcgccacagcctatgcagactctttgagggccgattcaccatctccagagacaacaccaataactccctctttctgcaaatgacgagtctgaagactgacgacactggtcttgtattactgtgtcaagaggtggcgcgataggagccttt

SEQ ID NO: 529772 - DNA, 504 bp, Homo sapiens
  misc_feature: HEFZJCU01EC0YK.19.53.E09.1.454.heavy.3.raw
tactctcgtgcacgaccggtgctcgatttagagagagtgtgttgggtttggggagctctgggagaggagccccagccctgagattccccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcacgtgggtccggcaagctccagggaagggcctggagtgggtctcaggtattagttggaatagtgctagtatagcctatgcggactctgtgaagggcgattcaccatctccagagacaacgccaaagaactccctgtatctgcaaatgaacagtctgagagctggaggacacggccttgtatttacgtgttggacaagggaggtaataacg

SEQ ID NO: 529773 - DNA, 504 bp, Homo sapiens
  misc_feature: HEFZJCU01DSFI1.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactactgtgaagggccgattcatcatctccagagacaatggcaacaactcactgtatctggaaatcaacagacctgagagtcgaggacacggctgtatattattagtgcgagagccccctaacggtgtaccg

SEQ ID NO: 529774 - DNA, 504 bp, Homo sapiens
  misc_feature: HEFZJCU01EIH1O.48.57.F02.1.454.heavy.3.raw
agtatacatacacgaccggtgctcgatttagctcgatatagttgggtttgggggctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggtatttcacctacacac

SEQ ID NO: 529775 - DNA, 530 bp, Homo sapiens
  misc_feature: HEFZJCU01D92J3.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgagggggccgattcaccatctccagagacaactctaagaacacgctgtttcttcaaatgaacagcctgagagccgatgacacggccgtgtattactgtgcgagagagtggggcccgacgaacgttactacgctatggacgtcgtggggccaagggaccac

SEQ ID NO: 529776 - DNA, 521 bp, Homo sapiens
  misc_feature: HEFZJCU01EXR2G.40.34.D01.1.454.heavy.3.raw
  modified_base (459)..(459): a, c, t, g, unknown or other
tctagcgactcacgaccggtgctcgatttagatcgtctgtgttgggtttgggggagtctccctcactgcccagctgggatctcagggcttcattttctgtcctccaccatcatgggggcaaccgccatcctcgccctcctcctggctgttgtccaaggagtctgtgccgaggtgcagctggtgcagtctggagcagaggtgaaaaagcccggggagtctctgaagatctcctgtaagggttttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcacgtggagcagtctgcacggcctcggacaccgccatgtacttctgtncgagaggggttcggggatgactacgtggggccaaggggaccctaggtcaccgtctcttcagt

SEQ ID NO: 529777 - DNA, 504 bp, Homo sapiens
  misc_feature: HEFZJCU01CIN36.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgctggtcaaggactactccacctactac

SEQ ID NO: 529778 - DNA, 517 bp, Homo sapiens
  misc_feature: HEFZJCU01D2HOE.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacactccattacggtttggacgtcgtggggccgaagggaccgacggtcatcgtctcccagcctccaccacgggcccatcggtccttcccccgtggccgccctcgctccgacgg

SEQ ID NO: 529779 - DNA, 482 bp, Homo sapiens
  misc_feature: HEFZJCU01A8PUB.49.27.C05.1.454.heavy.3.raw
  modified_base (445)..(445): a, c, t, g, unknown or other
agtcgagagacacgaccggtgctcgatttagacgcgatcgaagggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatgggaagcaagatatactatgtagactccgtgaagggccgattcatcatctccagagacaactccgagaacacgctgtatctgcaaatgaacaggctgngagctgaagacacggctgtatattactgtgcgaactt

SEQ ID NO: 529780 - DNA, 531 bp, Homo sapiens
  misc_feature: HEFZJCU01D6QGT.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtctttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactacgtggggccggggagccccgggtcatcgtctccg

SEQ ID NO: 529781 - DNA, 524 bp, Homo sapiens
  misc_feature: HEFZJCU01EIZQ8.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagacctccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccgaacgggaccg

SEQ ID NO: 529782 - DNA, 501 bp, Homo sapiens
  misc_feature: HEFZJCU01DN6AE.49.17.B06.1.454.heavy.3.raw
agtcgagagacacgaccggtgctcgatttagtcgatagtgaaggggtctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaaacacgcctacggagacctagaggacacggcttctcttttactgttgccgccaggaagcaggtggctgggcc

SEQ ID NO: 529783 - DNA, 526 bp, Homo sapiens
  misc_feature: HEFZJCU01EMUX5.12.40.D07.1.454.heavy.3.raw
atacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggccctggtcatcgtctccccacgcctccaccgacggcccactccggtccttccccctggccgt

SEQ ID NO: 529784 - DNA, 488 bp, Homo sapiens
  misc_feature: HEFZJCU01DSE32.48.71.G05.1.454.heavy.3.raw
agtatacatacacgaccggtgctcgatttagtgtcgtcgcaagagagagggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgagtctgaagacacgggcatatatttctgtgcgacagatggtcgtggattctcgtctgtctta

SEQ ID NO: 529785 - DNA, 493 bp, Homo sapiens
  misc_feature: HEFZJCU01CCT8F.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggccaccctcctccaagagcacctctgggggcacgagcggccctgggctgcctggtcaaggactacttccgagtgcgtct

SEQ ID NO: 529786 - DNA, 523 bp, Homo sapiens
  misc_feature: HEFZJCU01BW3DA.17.25.C03.1.454.heavy.3.raw
cgtagactagcacgaccggtgctcgatttagtagtgtagatttgggtttggggactcaacaaccacatctgtcctctagagaaaaccctgttgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattacgtgtgcgagagtcccacgagttcccggtgacggccctacggggccaggccggtcccttttgaccgtttcgtc

SEQ ID NO: 529787 - DNA, 491 bp, Homo sapiens
  misc_feature: HEFZJCU01A6BC8.47.85.H08.1.454.heavy.3.raw
  modified_base (446)..(446): a, c, t, g, unknown or other
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgacctcctggggccagggaaccctggtcatcgtctcctcagcctccaccaagggcccatccggtcttccccctggccgccctgctccaggacgcacctccgagancacagcggcctggctgcctgtcaggactacttcctacgtgacgct

SEQ ID NO: 529788 - DNA, 496 bp, Homo sapiens
  misc_feature: HEFZJCU01C78GH.51.83.H06.1.454.heavy.3.raw
cgatcgtatacacgaccggtgctcgatttagatcacgtgcgtcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggagcgtggtccagcctgggaggtccctgcgactctcctgtgcagcctctggattcagcttcagggctaatactatgttctgggtgcgccaggctccaggcaaggggctggagtgggtggcagtcatctggcctgatggagtttaacatactatgcggactccgtggagggccgattcaccgtctcccagagacactccaaaacacgctgtatctccaaatgagcagcctcagatctgaggacacggctatctactactgtgtgaaagagttgggtttcagtggcgttacg

SEQ ID NO: 529789 - DNA, 492 bp, Homo sapiens; identical to SEQ ID NO: 446706
  misc_feature: HEFZJCU01AE1CQ.11.71.G05.1.454.heavy.3.raw

SEQ ID NO: 529790 - DNA, 504 bp, Homo sapiens
  misc_feature: HEFZJCU01B6UA6.11.71.G05.1.454.heavy.3.raw
cgagagataccacgaccggtgctcgatttagtgtcgtcgcaagagagaggagcccagcactagaagtcggcggtgtttccattcggtgatcagcactgagcacagaggactcaccatggagtttgggctgagctgggttttcctcgttgctcttttaagaggtgtccagtgtcaggtgcaactggaggagtctggggggaggcgtggtccaggcctggggaggtccctgagactctcctgtacagcctctggcttcaccttcattacctatggcatgcactgggtccgccagactccaggcagggggctggagtgggtggcagttatttcatatgatgggaaataggtgacttctattcagactccgtgaagggccgattcaccgtctccagagacaattccaggcacacgctgtatctgcaatgaacagcctgagagctgaggacacggctgtgtattactgtcgcgaaagtatttctagtagaggtgacgtacggggggtcg

SEQ ID NO: 529791 - DNA, 382 bp, Homo sapiens
  misc_feature: HEFZJCU01CKKPY.11.61.F06.1.454.heavy.3.raw
cgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgcctgctccaggagcacctccgagagcacagcggccctgggctgcctggtcaaggactacttccgtatctctcg

SEQ ID NO: 529792 - DNA, 335 bp, Homo sapiens; identical to SEQ ID NO: 466862
  misc_feature: HEFZJCU01DN0EG.15.87.H10.1.454.heavy.3.raw

SEQ ID NO: 529793 - DNA, 508 bp, Homo sapiens
  misc_feature: HEFZJCU01CZL03.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccgacatactacgcagactccgtgaagggccggttcaccatctcagagacaattccaagaacacactgtatctgcaaatgaacagcctgagagccgacgacacggccatatattactgtgacgaaagcaccggcagttagtcaacccatactactttgactactgggg

SEQ ID NO: 529794 - DNA, 488 bp, Homo sapiens
  misc_feature: HEFZJCU01B08MJ.51.52.E08.1.454.heavy.3.raw
cgatcgtatacacgaccggtgctcgatttagtcgagctctcagagagaaagggggcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagccctgaccgacacggccgtgtatttttgtgtgagagattttcggacaatccagagacccctgt

SEQ ID NO: 529795 - DNA, 499 bp, Homo sapiens
  misc_feature: HEFZJCU01DVMTY.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtggggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttcatagaggtgacgtac

SEQ ID NO: 529796 - DNA, 501 bp, Homo sapiens
  misc_feature: HEFZJCU01EWPDI.11.27.C05.1.454.heavy.3.raw
  modified_base (470)..(470): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgttcagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccactctccagagacaacgccaagaactcactgtatctgcaaatgaacagcctgagagccgaggacacggctgtgtattactntgcgagaggagctattatctggaaccccgat

SEQ ID NO: 529797 - DNA, 507 bp, Homo sapiens
  misc_feature: HEFZJCU01D43VE.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagagggaagtgggatattgtggcagctccaggtgcccagccgggccctactttgactacgtc

SEQ ID NO: 529798 - DNA, 468 bp, Homo sapiens
  misc_feature: HEFZJCU01BASCT.19.10.A10.1.454.heavy.3.raw
  modified_base (437)..(437): a, c, t, g, unknown or other
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactatgtaacaaatgaatacgtggggacgggggaaattggggccagggaaccctggtctccgtctcgtcagcctccaccaagggccccatcggtcttccccctggccgccctgctcccaggagcacctccgagagcaccagcggccctgggcngcctggtcaaggactacttcccacgagagta

SEQ ID NO: 529799 - DNA, 540 bp, Homo sapiens
  misc_feature: HEFZJCU01AZZFT.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccgaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattaactgtggtgggggcatttacttgtacccctgggggcccgggggaaccctgggtcaccgtctccccaccctcccaaccg

SEQ ID NO: 529800 - DNA, 399 bp, Homo sapiens
  misc_feature: HEFZJCU01BY4UJ.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcgtcttccccctggcgccctgctccaggagcacctccgagagcacagcggccctgggctgcctggtcaaggactacttcctacgtgagct

SEQ ID NO: 529801 - DNA, 532 bp, Homo sapiens
  misc_feature: HEFZJCU01ASQQP.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactaacacagactccgtgaagggccgattcaccatctcagaagacaattccaggaacacattgtatcttcaaatgaataacctgagagccgaggaccacgggccatgtattactgtgtggggcatttactcgaccctggggccggggaaccctggtcaccgtctccccaccctcctaccg

SEQ ID NO: 529802 - DNA, 491 bp, Homo sapiens
  misc_feature: HEFZJCU01DOMFE.10.38.D05.1.454.heavy.3.raw
  modified_base (477)..(477): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagtttttggctgagctgggttttccttgttgctattttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacacatctgtatcttcacatgcacaatctgagagtcgacgacacggccacctattattgtgcgcgacatnactacgctcaattc

SEQ ID NO: 529803 - DNA, 506 bp, Homo sapiens
  misc_feature: HEFZJCU01C6SGQ.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagaacgtaaagtagacgtggtagtccgggggacacatgacaccg

SEQ ID NO: 529804 - DNA, 527 bp, Homo sapiens
  misc_feature: HEFZJCU01CH30D.49.86.H09.1.454.heavy.3.raw
agtcgagagacacgaccggtgctcgatttagtgctatagacttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccgagggaaccgtcggtccgaccgtcctcctctcgtcccg

SEQ ID NO: 529805 - DNA, 559 bp, Homo sapiens
  misc_feature: HEFZJCU01AXUTO.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtaaggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactgggtggcacagactatgcacaggggctccaggggcagactcaccatgaccacagacacatcagacgaacacagtcaacatggagttgcggagcctgcgatctgacgacgcggccgtatattacttgtgcggagtagtacggtaggcggctcggtccttttaggaccttaacgtcggggggtcccgtaggggggtaaccttcgttcggtcctaccccggttcttccccg

SEQ ID NO: 529806 - DNA, 527 bp, Homo sapiens
  misc_feature: HEFZJCU01B3MMP.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccagggaaccctggtcaccgtctcctcagctccaccg

SEQ ID NO: 529807 - DNA, 375 bp, Homo sapiens; identical to SEQ ID NO: 460227
  misc_feature: HEFZJCU01DJ2KA.49.61.F06.1.454.heavy.3.raw

SEQ ID NO: 529808 - DNA, 555 bp, Homo sapiens
  misc_feature: HEFZJCU01ANQJ7.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggcttgttctggggccgacgggggaccctggtcatccgtctccccacgcccgtcccaccgaacggggccccagtccgggttccttcccccgttcgggccggtcccgtccg

SEQ ID NO: 529809 - DNA, 398 bp, Homo sapiens
  misc_feature: HEFZJCU01DBSRM.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggcttgcctggtcaaggactaccttcctacgtgagct

SEQ ID NO: 529810 - DNA, 498 bp, Homo sapiens
  misc_feature: HEFZJCU01A2HWT.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgtctttgatatgtgggacg

SEQ ID NO: 529811 - DNA, 501 bp, Homo sapiens
  misc_feature: HEFZJCU01EV9MC.52.77.G11.1.454.heavy.3.raw
  modified_base (423)..(423): a, c, t, g, unknown or other
cgcagtacgacacgaccggtgctcgatttagctagtcactcaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaaagaacacgctntatttgcaaatgaacagcctgagagctgacgggacacggctgttgtattactgtcgcgaactttaatcgacggaacgg

SEQ ID NO: 529812 - DNA, 502 bp, Homo sapiens; identical to SEQ ID NO: 445538
  misc_feature: HEFZJCU01D3A7D.17.10.A10.1.454.heavy.3.raw

SEQ ID NO: 529813 - DNA, 498 bp, Homo sapiens
  misc_feature: HEFZJCU01BZGXC.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccaggagcacctccgagagcac

SEQ ID NO: 529814 - DNA, 508 bp, Homo sapiens
  misc_feature: HEFZJCU01CJ5VG.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtactacatggagctgtggagcctgagacctgacgacacggccctctattactgtgcgaggccctatcctacagtgaccactccacgctggttcgacctctcggggccac

SEQ ID NO: 529815 - DNA, 519 bp, Homo sapiens
  misc_feature: HEFZJCU01DXQUU.13.76.G10.1.454.heavy.3.raw
  modified_base (387)..(387): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccanagacaattccaagaacacgctgttcttcaaatgaacagcctgagagccgatgacacggccgtgtattactgtgcgagagatggggcccacgaacgttactacgctatggaccgtcgtggggccaagggaccg

SEQ ID NO: 529816 - DNA, 493 bp, Homo sapiens
  misc_feature: HEFZJCU01BN6Y8.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctggcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttcttgactccgtggggccagggaccctggtccaccgtctcctcg

SEQ ID NO: 529817 - DNA, 496 bp, Homo sapiens
  misc_feature: HEFZJCU01CLG1J.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggcttggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagcacagcggccctgggctgctaggtcaggactactccagtcgctaga

SEQ ID NO: 529818 - DNA, 533 bp, Homo sapiens
  misc_feature: HEFZJCU01C9YZY.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacacttcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatccggtcttcccccgtggccgccctcg

SEQ ID NO: 529819 - DNA, 529 bp, Homo sapiens
  misc_feature: HEFZJCU01C5RJO.4.35.D02.1.454.heavy.3.raw
agcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaaggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatgggttcgggagactcccagtggttttgattactatggggccagggggacaggcggtcaccgtctctttcaggcctcccg

SEQ ID NO: 529820 - DNA, 506 bp, Homo sapiens
  misc_feature: HEFZJCU01EYBSR.53.1.A01.1.454.heavy.3.raw
cgcgtatacacacgaccggtgctcgatttagacgtctcatcagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttgggtattacaaaaaatgcacagaggtttcagggcagagtcctgttaaccgcggacaaatccactaccacagtctacatggagctgagcagcctgagatctgaagacacggccctggtactattgtgcgagagaaatgtacttctatgacatactaatcaatatagtcttttgattgtc

SEQ ID NO: 529821 - DNA, 493 bp, Homo sapiens
  misc_feature: HEFZJCU01C8QHO.19.59.F04.1.454.heavy.3.raw
  modified_base (411)..(411): a, c, t, g, unknown or other
tactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctggggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatctccagaganagcgccaagaactcactgtatctgcaaatgaacagcctgagagccgaggacacggcagtttatactgtgcgagagagtggct

SEQ ID NO: 529822 - DNA, 501 bp, Homo sapiens
  misc_feature: HEFZJCU01ECRIA.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatagactccgtcccccggactttacg

SEQ ID NO: 529823 - DNA, 409 bp, Homo sapiens
  misc_feature: HEFZJCU01BKFKY.51.71.G05.1.454.heavy.3.raw
cgatcgtatacacgaccggtgctcgatttagtgtcgtcgcaagagagaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacgagcggccctgggctgcctggtcaaggactacttcctcgtagcact

SEQ ID NO: 529824 - DNA, 501 bp, Homo sapiens
  misc_feature: HEFZJCU01D8DG9.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttcccaggacagagtcaccatgaccacagacacatccacgagcacagcctacactggaactgaggagcctgagatctgacgacacggccgtatattttctgcgcgagagacgtaaagtgacgtaggtagttccggggggacac

SEQ ID NO: 529825 - DNA, 386 bp, Homo sapiens
  misc_feature: HEFZJCU01DFEUX.11.27.C05.1.454.heavy.3.raw
cgagagataccacgaccggtgctcgatttagacgcgatcgaagggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgatgcttttgatttctggggccaagggacaatgctcaccgtctcttcagcctccaccaagggcccatcggtcttccccctggcaccctcctccaagagcacctctgggggcacagcggccctgggctgcctggtcaaggactacttccgtatctctcg

SEQ ID NO: 529826 - DNA, 526 bp, Homo sapiens
  misc_feature: HEFZJCU01BNYKJ.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatagcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaattggaccgcctgagagacgaggacacgggctatgtattactgtgcgagagatgagagtggctacgaggttgggggaccgggggaaccctgggtccaccggtctaac

SEQ ID NO: 529827 - DNA, 526 bp, Homo sapiens
  misc_feature: HEFZJCU01BZQ20.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatggggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaaggcccatcggtccttccccctggccgccctcgcctccaggagcaccctcgtggggggtccacgagccc

SEQ ID NO: 529828 - DNA, 534 bp, Homo sapiens
  misc_feature: HEFZJCU01AS67F.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccatgactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaagggcccatcggtcttcccctcggcaccctcctccaacg

SEQ ID NO: 529829 - DNA, 521 bp, Homo sapiens
  misc_feature: HEFZJCU01EI27A.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagagggccgttattttaggaccagctagttaaaaactcctactacggtctggacgtctggggccaggggaccaac

SEQ ID NO: 529830 - DNA, 508 bp, Homo sapiens
  misc_feature: HEFZJCU01BNZTB.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactggtgcgaggccctatcctacagtgaccactccacgctggttccgacctctggggccac

SEQ ID NO: 529831 - DNA, 514 bp, Homo sapiens
  misc_feature: HEFZJCU01EUIJT.4.23.C01.1.454.heavy.3.raw
  modified_base (407)..(407): a, c, t, g, unknown or other
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacggagcacacgcctacntggacctgaggagcctgagatttgacgacacgggccatatattactgtgcgagagagttgggccgacggaaccttgactactggggccagggaaccctggtcaccgt

SEQ ID NO: 529832 - DNA, 513 bp, Homo sapiens
  misc_feature: HEFZJCU01B8QA6.10.59.F04.1.454.heavy.3.raw
  modified_base (511)..(511): a, c, t, g, unknown or other
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtggactacccactacaacccgtccctcaggagtcgagtcaccatctcactagacacgtccaggaatcacctctccctgacggtgacctctgtcgaccgccgcggacacggccgtgtattattgtgcgagacgaccccgctgaagattcctcatgtacttgaccactggggccagggagccctggtcaccgtctcctacncg

SEQ ID NO: 529833 - DNA, 502 bp, Homo sapiens
  misc_feature: HEFZJCU01CB870.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaacgggccgtattcaccatcctccagagacaattccaagaacacgcagtatctgcaaatgaacagcctgagagtctgaggacgacggctgtagttattactggtgggagagagtggaggtcgatattgta

SEQ ID NO: 529834 - DNA, 510 bp, Homo sapiens
  misc_feature: HEFZJCU01A8Q1I.53.61.F06.1.454.heavy.3.raw
cgcgtatacacacgaccggtgctcgatttagctacgctctaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggttgagtgggaattaggggctgagtacggtatggacgtctggggccaagggaccacggtcaccgtctcctcg

SEQ ID NO: 529835 - DNA, 528 bp, Homo sapiens
  misc_feature: HEFZJCU01DYKQV.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattccaccgtctccagagacaacaccaagaacacactatatctgcagattgacagtctgagacccgaggacacggctgtgtattactgtgcaaggcagttcgtggaaacagttatgggttggggggagttgggttttttttcgtacgtacggg

SEQ ID NO: 529836 - DNA, 513 bp, Homo sapiens
  misc_feature: HEFZJCU01EBWBQ.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtgcagttgtttcatctgagggcagtgttcaatggtatgcagactccgtgaacgggccgattcaccatctccagagacaattccaggaacacaatgtatttggaaatgaacagcctaagtcctgaggacacgggtgtatactactgtacgaagggaggggggaaccagcgggagttccaagtactctttg

SEQ ID NO: 529837 - DNA, 483 bp, Homo sapiens
  misc_feature: HEFZJCU01EXP63.26.78.H01.1.454.heavy.3.raw
  modified_base (459)..(459): a, c, t, g, unknown or other
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtnttttactgtgcgagagagatgacg

SEQ ID NO: 529838 - DNA, 540 bp, Homo sapiens
  misc_feature: HEFZJCU01B0F26.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttagttgggggccaggggacgccctggtcctaccg

SEQ ID NO: 529839 - DNA, 501 bp, Homo sapiens
  misc_feature: HEFZJCU01EP824.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggccgccctgctccaggagcacctccgagagccacaggcgcccgtgggccgtgcctggtcaacggactacttcctacgtgagctcgtgac

SEQ ID NO: 529840 - DNA, 392 bp, Homo sapiens
  misc_feature: HEFZJCU01CWIVD.7.60.F05.1.454.heavy.3.raw
cgtgtctctacacgaccggtgctcgatttagtacgtcatcagggaaaggggctggagtgggtctcagtgatttatagttagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttcccctggcgccctgctccaggagcacctccgagagcacagcggccctgggctgcctggtcaaggactacttcctagagacacg

SEQ ID NO: 529841 - DNA, 524 bp, Homo sapiens
  misc_feature: HEFZJCU01CEP4I.49.13.B02.1.454.heavy.3.raw
agtcgagagacacgaccggtgctcgatttagtctagcgacttccgcgggggggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgactagtagttggttcttccgtacgtatgcgacattacggt

SEQ ID NO: 529842 - DNA, 532 bp, Homo sapiens
  misc_feature: HEFZJCU01A1VHB.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccggggaaccctggtccaccgtctccccacccctccaccg

SEQ ID NO: 529843 - DNA, 397 bp, Homo sapiens
  misc_feature: HEFZJCU01A6Y3E.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccgagggcccatcggtcttccccctggcgccctgctccaggagcacctccgagagcacagcggccctgggcctgcctggtcaaggactacttcctacgtgagct

SEQ ID NO: 529844 - DNA, 524 bp, Homo sapiens
  misc_feature: HEFZJCU01C1S4Z.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccaggagacttttctctagaacacactgtctcttcaaatgaacagcctgagggccgaggacacggccgtctattattcgtgtggagtaggttttatggcgaagtggctggtgggacagatcactggggccaac

SEQ ID NO: 529845 - DNA, 494 bp, Homo sapiens
  misc_feature: HEFZJCU01DF8TV.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactggtgggagagatgggaggtcgatattgt

SEQ ID NO: 529846 - DNA, 494 bp, Homo sapiens
  misc_feature: HEFZJCU01CX9H6.53.9.A09.1.454.heavy.3.raw
cgcgtatacacacgaccggtgctcgatttagcgagacgcgcaggggctgaaagcatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctgggcctcagtgatgatttcctgcacgacatctggatacaccttcaccgactcccttatacattgggtacgacaggcccctggacagggggcttgagtggatgggtctaatcaaccctagtggtggatctacaagttactcacgagagaatgcagggccgaatttaccatgaccagacgacacgtccacgagtacagtctacatggaggtgagcagcctgagatctgaggacgacggccatgtattacgtgtgcgatcttagtggtattacgactaacaattta

SEQ ID NO: 529847 - DNA, 398 bp, Homo sapiens
  misc_feature: HEFZJCU01BN6ZP.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctaatagcagtgcccccctacgcgcacttctttgacttctggggccagggaatcctggtcaccgtctccacagcctccaccaagggcccatcggtcttccccctggcgccctgctccaggagcaccctccgagagcacagcggcctgggctgcctggtcaaggactacttcctacgtgagct

SEQ ID NO: 529848 - DNA, 520 bp, Homo sapiens
  misc_feature: HEFZJCU01D8138.9.36.D03.1.454.heavy.3.raw
tgatacgtctcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatagtacagcctcagcgccgaggacgacggccgtctaccttctgtgcgaaagacctctatttttgggccgcgggccgactactcggggccgac

SEQ ID NO: 529849 - DNA, 502 bp, Homo sapiens
  misc_feature: HEFZJCU01CZ1HV.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacattctgtatcttcacatgcacaatctgagagtcgacgacacggccacctattattgtgcgcgacatgactacgctcaattctggggccg

SEQ ID NO: 529850 - DNA, 393 bp, Homo sapiens
  misc_feature: HEFZJCU01E1DLM.49.42.D09.1.454.heavy.3.raw
agtcgagagacacgaccggtgctcgatttagacacatacgcagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactacggtgtggacgtctggggccaagggaccacggtcaccgtctcctcagcctccaccaagggcccatcggtcttcccccctggcaccctcctccaagagcacctctgggggcacagcggccctgggctggcctggtcaaggactacgttcctctctcgact

SEQ ID NO: 529851 - DNA, 538 bp, Homo sapiens
  misc_feature: HEFZJCU01DS6Z5.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttggttccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgttttagtggggccaggggagccctggtcctaccg

SEQ ID NO: 529852 - DNA, 500 bp, Homo sapiens
  misc_feature: HEFZJCU01EI6TK.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgacggacacagcccatgtatttattgtacattaggacact

SEQ ID NO: 529853 - DNA, 522 bp, Homo sapiens
  misc_feature: HEFZJCU01DA92B.2.81.H04.1.454.heavy.3.raw
  modified_base (481)..(481): a, c, t, g, unknown or other
acgctcgacacacgaccggtgctcgatttagtagtgtagattcgcggggctgccctttggctttggagatggttttctcgatgggggctgggagggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggagctgggtccagcctggggggtccctgagactctcctgttcagcctctggattcacctttagtaggttttggatgagttggtccgccaggctccagggaaggggctggagtgggtggccaacatagagtacgatggaagtgagaaaaactatgtggactccgtgaagggccgattcgaccatcctccagagacaacgacaagaatttagtgtatctgcaaatgagnagcctgagagccgaggacacggctgtgtattattgtgcgag

SEQ ID NO: 529854 - DNA, 498 bp, Homo sapiens
  misc_feature: HEFZJCU01CQJB7.40.81.H04.1.454.heavy.3.raw
  modified_base (484)..(484): a, c, t, g, unknown or other
tctagcgactcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcgaccatgacctgggacgcggtccatcagcacagtctacatggatctgagcggactggacctctgacgacacggccatgtaattctgtggaagagacgttggtggcaccggnggggctgacacgtc

SEQ ID NO: 529855 - DNA, 500 bp, Homo sapiens; identical to SEQ ID NO: 520432
  misc_feature: HEFZJCU01CJ8EC.26.23.C01.1.454.heavy.3.raw

SEQ ID NO: 529856 - DNA, 494 bp, Homo sapiens
  misc_feature: HEFZJCU01CW2CZ.3.34.D01.1.454.heavy.3.raw
  modified_base (211)..(211): a, c, t, g, unknown or other
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtnaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggccaccctcctccaagagcacctctgggggcacagcggcccgtgggctgcctggtcaaggactacttcccgagtgcgtct

SEQ ID NO: 529857 - DNA, 518 bp, Homo sapiens
  misc_feature: HEFZJCU01ASPRO.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccagccgggggggtccctgagactctcctgtgcagtctctggattcacccttagaagttattggatgacctgggtccgccaggctccagggaaggggctgggagtgggtggccaacataaacaaagacggaagtcagaaaactatgtggactctgtgaacggccgattcaccatctaccagagacaacgccaagaattcactgtatttgcaaatgaacagcctgagaggcggaggacacggccgtgtattattgtgcgtcgagatgatagtagaactctaacagtagcaggtggta

SEQ ID NO: 529858 - DNA, 517 bp, Homo sapiens
  misc_feature: HEFZJCU01A3Q02.52.67.G01.1.454.heavy.3.raw
cgcagtacgacacgaccggtgctcgatttagagtatacatattgggtttggggacccaacaaccacatccctcctcagaagccccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgaggaggggaaatggcctccaccaagggcccagtcggtcttccccctggccaccctcctccaacg

SEQ ID NO: 529859 - DNA, 451 bp, Homo sapiens
  misc_feature: HEFZJCU01B5QS0.53.57.F02.1.454.heavy.3.raw
cgcgtatacacacgaccggtgctcgatttagctcgatatagttgggtttgggctcggggctgccctttggctttggagatggttttctcgatgggggctggagtgggtggcagttatatcaaatgatggaagtaagaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgccctggtcaaggactaacttcctcgtactgcg

SEQ ID NO: 529860 - DNA, 508 bp, Homo sapiens
  misc_feature: HEFZJCU01BFNAE.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcttcggtcgcgggacttctggggccagggaaccct

SEQ ID NO: 529861 - DNA, 510 bp, Homo sapiens
  misc_feature: HEFZJCU01C7OW6.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacggtgtctatttctgtgcgagactgcccggtcctgcacctcgtgtggccccaatttggtttaccggtcacacaaaatcagggcaagtcctacgacggtctc

SEQ ID NO: 529862 - DNA, 530 bp, Homo sapiens
  misc_feature: HEFZJCU01BYFOW.10.35.D02.1.454.heavy.3.raw
catagtagtgcacgaccggtgctcgatttagcacacgatagttgggtttgggggggagaggagccccagccctgggattcccaagtgtcttcattcagtgatcagtactgaacacagaggactcaccatggagtttgggctgaggtggattttccttgctgcaattttaaaaggtgtccagtgtgacgtgcagttggtggagtctggggaggcttggttaagccgggggggtcccttagactctcctgttcagcctctggattcagtgtcactaacgcctggatgagctgggtccgccagtccccagggaagggctggagtgggttggccttattaggaagcagacctgatggtgggacaacagagtacgctggattcgtaaaaggcagattcgccatctcaattgatgagtcaaagaacaccgtgtatctggaaatgagcagcctggaaagcgatgacacaggactctattattggtaccactaagagttcccaacgaagacctggtgggaagggaactgcgtggggcc

SEQ ID NO: 529863 - DNA, 508 bp, Homo sapiens
  misc_feature: HEFZJCU01E03FR.3.71.G05.1.454.heavy.3.raw
agacgcactccacgaccggtgctcgatttagtgtcgtcgcaagagagaggggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacgttggaatagtgataacatcggctatgcggactctgtgaagggccgattcaccatctccagagacaacggccaagaactccctgtatctgcaaatgaacagtctgagacctggaggacacggccttgtattactgtgtaaacgtcccggggaaatatgtacg

SEQ ID NO: 529864 - DNA, 491 bp, Homo sapiens; identical to SEQ ID NO: 482877
  misc_feature: HEFZJCU01CYV1E.3.34.D01.1.454.heavy.3.raw

SEQ ID NO: 529865 - DNA, 515 bp, Homo sapiens; identical to SEQ ID NO: 451741
  misc_feature: HEFZJCU01CW8NK.13.76.G10.1.454.heavy.3.raw

SEQ ID NO: 529866 - DNA, 506 bp, Homo sapiens
  misc_feature: HEFZJCU01BF6EP.10.38.D05.1.454.heavy.3.raw
  modified_base (63)..(63): a, c, t, g, unknown or other
catagtagtgcacgaccggtgctcgatttagtatctgatagttgggtttgggggggagaggancccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 529867 - DNA, 500 bp, Homo sapiens
  misc_feature: HEFZJCU01BO8RL.47.56.F01.1.454.heavy.3.raw
  modified_base (438)..(438): a, c, t, g, unknown or other
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagngaccgacgatgcggctgtatatttctgtgcaagagatcaactggcgggaccgactttattct

SEQ ID NO: 529868 - DNA, 523 bp, Homo sapiens
  misc_feature: HEFZJCU01B2RWS.8.26.C04.1.454.heavy.3.raw
ctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagctggctatttcttgtggctattttaaaaggtgtccagtgtgaggtgcagttgttggagtctgggggagggttggtacagcctggggggtccctgagactctcctgtgcagcctctggattcacctctggcagctttgtcatgagctgggtccgccaggctccagggaaggggctggagtgggtctcatctatgagtggtagtggtggtcacacacactacgcagactccgtgaaggggccggttcaccatcctccagagacaattccaagaacacggtgtatctgcaaatgaacagcctgagagccggaggacacgggccgtatacttactgtgacgaaagtatttttgtttcgggagtacctctattattacg

SEQ ID NO: 529869 - DNA, 516 bp, Homo sapiens
  misc_feature: HEFZJCU01A94DD.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaaacagcctgagaggcgaggacacggccgtgtattattgtgcgcgagatgataggtagacctctacagtagcagggtggta

SEQ ID NO: 529870 - DNA, 535 bp, Homo sapiens
  misc_feature: HEFZJCU01ESRV4.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccggccgcagacacggctgtctattactgtgcgaggccccgagcgcacgtggtcgtttttcgtattcgtccgtttgtattatggtcgggggaccgtaaggggaccgaaagtcggtactaccgttaccg

SEQ ID NO: 529871 - DNA, 508 bp, Homo sapiens
  misc_feature: HEFZJCU01D1JR8.2.53.E09.1.454.heavy.3.raw
  modified_base (428)..(428): a, c, t, g, unknown or other
acgctcgacacacgaccggtgctcgatttagagagagtgtgttgggtttggggcccctagatcacagctcctctccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatcccacgagcacagtcaacctggacctgaggagcctgacatctgacgacacggccgtgtattattgtgcgagnggaacgagggggggagcgacgccttttgactactggggccagggaaccctggtcaccgtctcctcagcctccaccacggg

SEQ ID NO: 529872 - DNA, 527 bp, Homo sapiens
  misc_feature: HEFZJCU01DM2AZ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaattaacgaacacagttaatctggagctgaacagcctgtcatctgaggacacgggcttctacttctgtgcgaggagtaattactataacactgctccttttacaccttccttgacttctgggccatcggaacccggtccg

SEQ ID NO: 529873 - DNA, 496 bp, Homo sapiens
  misc_feature: HEFZJCU01EN07T.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggatggtccctgagactctcctgtgcagcctctggatacatcttcaaaagtttcgaaatgagctgggtcccgccaggctccgtggggaaggggccggagtggatttcatacatcagtagtagtggtaacaccttgtactatgcagactctgtgaagggccgattcaccatctccagagacaacgccaagaattcactgtttctgcaaatagaacagcctgagagacgaggatacggctatttactatttgtgcgcgatcgacaagaaaagcggt

SEQ ID NO: 529874 - DNA, 542 bp, Homo sapiens
  misc_feature: HEFZJCU01BDNDW.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggctatttaacttgtaccccttgggggcccgggggtaacccgtggtccgaccggtcctccccacccctccaacccg

SEQ ID NO: 529875 - DNA, 514 bp, Homo sapiens
  misc_feature: HEFZJCU01AFNYY.48.70.G04.1.454.heavy.3.raw
agtatacatacacgaccggtgctcgatttagtgtagtgtgaagggaaaggggagctctgggagaggagccccagccctgagaatcccaggtgtttccattcagtgatcagcactgaacacagaggactcaccatggagttgggactgagctggattttccttttgactattttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccagggaagggcctggagtgggtctcaggcatcgattggaaagcgagaagattgactatgcggagtctgtgaaggggcgagttcatcatctccagagacaacgccaagaacctccctgtatttgcagatgaacaatctagagacctgacgacacggccttgtattattgtgacaaagttagtggagtcacagtctcgtggtaacg

SEQ ID NO: 529876 - DNA, 504 bp, Homo sapiens
  misc_feature: HEFZJCU01DGAOV.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatagtttctgtcgcgagagacgtaaaagtagaacggtggtagttccggggggacgac

SEQ ID NO: 529877 - DNA, 517 bp, Homo sapiens; identical to SEQ ID NO: 469285
  misc_feature: HEFZJCU01BOL3R.46.67.G01.1.454.heavy.3.raw

SEQ ID NO: 529878 - DNA, 385 bp, Homo sapiens
  misc_feature: HEFZJCU01CIB8F.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttcccccctggcgccctgctccaggagcactccgagagcaccagcggccctgggctgcctggtcaaggactacttccgtatctctcg

SEQ ID NO: 529879 - DNA, 514 bp, Homo sapiens; identical to SEQ ID NO: 492567
  misc_feature: HEFZJCU01B680W.3.34.D01.1.454.heavy.3.raw

SEQ ID NO: 529880 - DNA, 384 bp, Homo sapiens; identical to SEQ ID NO: 444454
  misc_feature: HEFZJCU01CBUVR.11.61.F06.1.454.heavy.3.raw

SEQ ID NO: 529881 - DNA, 484 bp, Homo sapiens; identical to SEQ ID NO: 445311
  misc_feature: HEFZJCU01DHMGH.11.23.C01.1.454.heavy.3.raw

SEQ ID NO: 529882 - DNA, 477 bp, Homo sapiens
  misc_feature: HEFZJCU01C76UG.16.71.G05.1.454.heavy.3.raw
tgtactactccacgaccggtgctcgatttagtgtcgtcgcaagagagaggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaacccctggtacaccgtctcctcagcctccaccaagggcccatcggtcttccccctggcaccctcctccaagagcacctctggggcacagcggccctgggctgcctggtcaaggactacttcgagtagtaca

SEQ ID NO: 529883 - DNA, 516 bp, Homo sapiens
  misc_feature: HEFZJCU01BFQTZ.17.25.C03.1.454.heavy.3.raw
cgtagactagcacgaccggtgctcgatttagtagtgtagatttgggtttggggaaccacgatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccagatccggtgacgcctaacggcagcggcctttggaccttctgggggcccagggaccg

SEQ ID NO: 529884 - DNA, 531 bp, Homo sapiens
  misc_feature: HEFZJCU01AX7GG.7.70.G04.1.454.heavy.3.raw
  modified_base (517)..(517): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattgggatacatctattactttgggagcacctactacaacccgtccctcaagagtcgagtaacgatctcagtggacacgtctaacaatcacctctccctgaggctgagctctgtgacagccgcggacacgggcgtttatactgtgcgagaggacggacgtacggtgactacgtgggggttcgtaccccgtggggccagggaaccctggtcaccgtctaccncacgcctaccaccg

SEQ ID NO: 529885 - DNA, 516 bp, Homo sapiens
  misc_feature: HEFZJCU01CAG5Z.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacacttgattactggggccggggaaccctggtcgccgtctcctcagcctccaccaagggccatcggtcttcccctggcaccctcctccaagagcacctctgggggcacagcggccctgggctgcctggtcaaggactacttccagacgtatca

SEQ ID NO: 529886 - DNA, 553 bp, Homo sapiens
  misc_feature: HEFZJCU01EH7JE.16.1.A01.1.454.heavy.3.raw
tgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaagggcctggagtggattggggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttctggggtccaagggacagtggtcatcgtctcctcagcctccaccaagggcccatcggtcttcccctggcaccctcctccaagagcacctctgggggcacagcggccctgggctgcctggtcgaagggactacttccgagtagtac

SEQ ID NO: 529887 - DNA, 504 bp, Homo sapiens
  misc_feature: HEFZJCU01BAOYK.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacactggagttgaggagcctgacatctgacgacacggccgtctattactgtgcgagagtcccacgatccggtgagcctacggcagcggcctttgacttctc

SEQ ID NO: 529888 - DNA, 428 bp, Homo sapiens
  misc_feature: HEFZJCU01BDNVV.53.65.F10.1.454.heavy.3.raw
cgcgtatacacacgaccggtgctcgatttagctacgctctaagggagtagagtcctgaggactgtaggctcccgggaaggggctggagtgggtctcaggtattagtggcagtggtggaatcacatactacgcagactccgtgaagggccggttcaccatctccagagacaactccaagaacacactgtttctacaaatgaatagcctgagagccgcggacacggccgtatattattgtgcgaaagtttgggggtggcaattggagtggtttttagatccgattgactactgggcctgggaaccctggtcaccgtctcctcagctccaccaaggcccatcggtcttcccctggcaccctcctccaagagcacctctgggggcacagcggccctgggctgcctggtcaaggactacttcctcgtactgcg

SEQ ID NO: 529889 - DNA, 513 bp, Homo sapiens; identical to SEQ ID NO: 446452
  misc_feature: HEFZJCU01B8J9B.17.33.C11.1.454.heavy.3.raw

SEQ ID NO: 529890 - DNA, 480 bp, Homo sapiens
  misc_feature: HEFZJCU01DS6EC.49.32.C10.1.454.heavy.3.raw
agtcgagagacacgaccggtgctcgatttagtatagacatcaacacacaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaact

SEQ ID NO: 529891 - DNA, 521 bp, Homo sapiens
  misc_feature: HEFZJCU01B0B1J.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagttctatagataacccaatttgggaggggccttt

SEQ ID NO: 529892 - DNA, 500 bp, Homo sapiens
  misc_feature: HEFZJCU01C77HT.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaaggccgattcaccgtctccagagacaattccaggcacacgctgtatctgcaaatgaacagcctgagagctgaggacacggctgtgtattactgtgcgaaagatttctatagaggtcgacgtac

SEQ ID NO: 529893 - DNA, 490 bp, Homo sapiens
  misc_feature: HEFZJCU01BTYPG.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaaataacaaatttatgcaccatcttgttgagagtcgactgacaatcaacgtagacacatacgaagaaccagttcctccctgcagctgacctctgtgactcccgaggacacgggtgtatattactgtggaagacggccccagtacg

SEQ ID NO: 529894 - DNA, 544 bp, Homo sapiens
  misc_feature: HEFZJCU01E0ODT.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggcagttttacttgtacccctcgggggcccgggggaacccgtggtcacccgtcctcccccacccctcccacccg

SEQ ID NO: 529895 - DNA, 496 bp, Homo sapiens
  misc_feature: HEFZJCU01BSSJH.3.34.D01.1.454.heavy.3.raw
agacgcactccacgaccggtgctcgatttagatcgtctgtgttgggtttggggggtccctgagactcgcctgcgcaccttcttggattcacctttagtacatatgtcatgacctgggtacgccaggctccagggaaggggctggagtgggtcgcaagtataaacggttcgtgctgataagacagcctacgcagacgccgtgaaggggcgggtgaccatctccagagacgaattacaagaacatgctgtatctgcgattgaacaacgtcagagccgacgacacggcccactattacttgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 529896 - DNA, 522 bp, Homo sapiens
  misc_feature: HEFZJCU01DCJD4.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtggagtacgaactacaatccgtcctcaagagtcgagtcatcatatccgtagacaggtccaggaacgaattctccctgaaagtgagttctgtgaccgtcgcagacacggctgtctattattgtgcgagacggacaaatatggttcaggggagttcgactacgtgggggccagggaaccctggtccaccgtctcctcagcctccacaggg

SEQ ID NO: 529897 - DNA, 493 bp, Homo sapiens
  misc_feature: HEFZJCU01DSON0.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacggctcggctgtatacttctgtgcgacaaacatgatgtttggagtggatgtgtac

SEQ ID NO: 529898 - DNA, 531 bp, Homo sapiens
  misc_feature: HEFZJCU01EAHLO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaaatagacagcctgagaccagacgacacggctgtctattattgcgcgagagagacacacgaacctactcggccaatactatgggggcttggttctgggggccgaggggaccctggtcatcgtctccccagcctccaccaacgggcccatcggtccttcccccgtggccg

SEQ ID NO: 529899 - DNA, 493 bp, Homo sapiens
  misc_feature: HEFZJCU01EWZOK.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggggtttgagtggatggggtggatcaaccctaccagaggtggcacaaagtatcgacagaactttcagggcagggtcaccatgacctgggacgcgtccatcagcacagtctacatggatctgagcgggactggacctcgtgacgacacggccatgtattctgtgaagagacgttggtggctaccgcgggtctcgacc

SEQ ID NO: 529900 - DNA, 514 bp, Homo sapiens
  misc_feature: HEFZJCU01BOWXN.17.25.C03.1.454.heavy.3.raw
  modified_base (454)..(454): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtncgagagtcccacgattcccggtagacgcctacggcacgcgggccttttggacctttcgtc

SEQ ID NO: 529901 - DNA, 511 bp, Homo sapiens
  misc_feature: HEFZJCU01A0GYS.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctgggtcaccggtctccttcagcctccaccaagggcccatcggtcttcccctggcaccctcctccaagagcacctctgggggcacagcggccctgggctgcctggtcaggactacttcctacgtcgtat

SEQ ID NO: 529902 - DNA, 503 bp, Homo sapiens
  misc_feature: HEFZJCU01A77H6.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaaccacggacacccccacgaacacagtctacatgcaactgacgagcctgagagctgacgacacggccgtcgtattactgtgcgagaatgttttctgtcatcgtacaatttgataggctctatggactggacttctc

SEQ ID NO: 529903 - DNA, 519 bp, Homo sapiens
  misc_feature: HEFZJCU01C2RNB.13.76.G10.1.454.heavy.3.raw
  modified_base (385)..(385): a, c, t, g, unknown or other
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagttcacacctacatgagctgggtccgccaggctccagggaaggggctggagtgcgtctcttttatttatagtagtggtagtacatactccgcagactccgtgaggggccgattcaccntctccagagacaattccaagaacacgctgtttcttcaaatgaacagcctgagacgccgatgacacggccgtgtattactgtgcgagagagtggggcccacgaacgttactacgctatggacgtcgtggggaccg

SEQ ID NO: 529904 - DNA, 511 bp, Homo sapiens
  misc_feature: HEFZJCU01EYHA8.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcctggtcaagcctggggggtccctgagactctcctgtgcagcctctgaattcatcttcagtatctataacatgaactgggtccgccagactccagggaaggggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatagttcggggattaagtataacgacgtatttcgta

SEQ ID NO: 529905 - DNA, 496 bp, Homo sapiens
  misc_feature: HEFZJCU01D5A4G.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccgtgaagggccgattcaccatctccagagacaattccaagaacacgcagtatctgcaaatagaacagcctgagagctgaggacacggctgtgtattactgtgggagagatggaggtcgatattagta

SEQ ID NO: 529906 - DNA, 502 bp, Homo sapiens
  misc_feature: HEFZJCU01ERDCQ.14.78.H01.1.454.heavy.3.raw
cgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaaggccgattcaccgtctccagggacaacgcaagaactcgctgtatctgcaaatcgacggcctgagagtcgaggacacggccatgtattctagtgcgagagtgtggttcggtcatgtttt

SEQ ID NO: 529907 - DNA, 498 bp, Homo sapiens
  misc_feature: HEFZJCU01CPGSK.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagactcactgtatctgcaaatgaacagcctgagagccgaggacaacggctagtgtattactgtgcgagagagctattatctggaaccccg

SEQ ID NO: 529908 - DNA, 496 bp, Homo sapiens
  misc_feature: HEFZJCU01CBT5H.51.86.H09.1.454.heavy.3.raw
cgatcgtatacacgaccggtgctcgatttagtgctatagacttgggtttggggtctgggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaattatgcagactccgtgaagggccgagttcaccatctccagagacaattccaagaacactctatatttgcagatgaatagcctgagaattgaggacacggctgtgtattactgtgtgagagggtcggcatattttc

SEQ ID NO: 529909 - DNA, 480 bp, Homo sapiens
  misc_feature: HEFZJCU01A0OVS.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcgtcttcccctgcaccctcctccaagagcacctctgggggcacagcggccctgggctgcctggtcaaggactacttcctagagacacg

SEQ ID NO: 529910 - DNA, 523 bp, Homo sapiens
  misc_feature: HEFZJCU01BHR5I.48.39.D06.1.454.heavy.3.raw
  modified_base (461)..(461): a, c, t, g, unknown or other
  modified_base (487)..(487): a, c, t, g, unknown or other
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacaggtgggagcacctactacaacccgtccctcaaaagtcgaggcaccataatccgtagacacgtcaagaaccaattctccctgaagctgagctctgtgacccgccgcacgacacgggctggtctattactgtgcgaggccccgagccggcngtggtcttttcgtatcgtccttttgnttaattggtggggtccgaaggggacaagtaggtccg

SEQ ID NO: 529911 - DNA, 519 bp, Homo sapiens
  misc_feature: HEFZJCU01EX7DE.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgtagcgccgcagacacggccgtgtatactgtgcgagacgtggccgcaacagactacggtggcaacctccctatgtccgtttttgattatctcgggggccaacggggaacaacgtt

SEQ ID NO: 529912 - DNA, 500 bp, Homo sapiens
  misc_feature: HEFZJCU01BYLAA.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctgggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctcggaaccccg

SEQ ID NO: 529913 - DNA, 501 bp, Homo sapiens
  misc_feature: HEFZJCU01A4693.14.33.C11.1.454.heavy.3.raw
cgtctagtaccacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagccaagatctgacgaccacggccgtttattattgtgcaataagaattgcaaacgatagcttttgtatatggtggggcc

SEQ ID NO: 529914 - DNA, 514 bp, Homo sapiens
  misc_feature: HEFZJCU01EPP75.3.34.D01.1.454.heavy.3.raw
  modified_base (511)..(511): a, c, t, g, unknown or other
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgccgtggggccaagggaccacggtcatcgctccgcagcctccaccaaggcccaatcggtcttcccctggcaccctcctcccagaagccacctctcgggggcacgagccggccctgggctgcctgtcaaggactacttccgagtncgt

SEQ ID NO: 529915 - DNA, 506 bp, Homo sapiens
  misc_feature: HEFZJCU01C749Q.48.19.B08.1.454.heavy.3.raw
  modified_base (356)..(356): a, c, t, g, unknown or other
  modified_base (475)..(475): a, c, t, g, unknown or other
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaagggctggagtggattgggagtatctattatagtgggagtacctactacaacccgtcctcaagagtcgactcaccatatccgtanacacgtccaagaaccagttctccctgaagctagagctctgtgaccgccgcagacacggctgtgtattactgtgacgagggggccgggatattgttatagaaccaccgtagctatctganctggttcgactgctggggccagggaccctgg

SEQ ID NO: 529916 - DNA, 509 bp, Homo sapiens
  misc_feature: HEFZJCU01DYNCS.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccggggacagacttaccatgaccacgaactcctccataaacacagcctacatggagttgaggagcctgacatctgacgacacggccgtctattactgtgcgagacgtccacgacgtccggtgagccctacggcagcggcctttgtacttcgtc

SEQ ID NO: 529917 - DNA, 535 bp, Homo sapiens
  misc_feature: HEFZJCU01BHHY2.48.37.D04.1.454.heavy.3.raw
agtatacatacacgaccggtgctcgatttagtagcatactgttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatatttactttgacaacgtggggccgaggggaaccctggtcaccgtcctcctcagcctccacccgaacgggcccacgtcggtccttcccccgtggcccgccctcggctcccgagg

SEQ ID NO: 529918 - DNA, 489 bp, Homo sapiens
  misc_feature: HEFZJCU01BKITW.47.85.H08.1.454.heavy.3.raw
  modified_base (453)..(453): a, c, t, g, unknown or other
  modified_base (476)..(476): a, c, t, g, unknown or other
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgagggccgattcaccatctccagagacaattccagaacacggtctatctgcacctgaccagcctgagaactgacganacgtctctctactactgtgcganagagttgacgagt

SEQ ID NO: 529919 - DNA, 497 bp, Homo sapiens
  misc_feature: HEFZJCU01AGVUE.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattacgtggtgggagagatgggaggtcgatattgtta

SEQ ID NO: 529920 - DNA, 495 bp, Homo sapiens
  misc_feature: HEFZJCU01BTW0R.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctaggaaatcaacagcctgagagtcgaggacacggctgtatattattgtgcgagacgcccctacggt

SEQ ID NO: 529921 - DNA, 538 bp, Homo sapiens
  misc_feature: HEFZJCU01CQG1I.17.28.C06.1.454.heavy.3.raw
  modified_base (524)..(524): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttagttggggccagggancccgtggtctaccg

SEQ ID NO: 529922 - DNA, 486 bp, Homo sapiens; identical to SEQ ID NO: 448127
  misc_feature: HEFZJCU01BCSRL.49.8.A08.1.454.heavy.3.raw

SEQ ID NO: 529923 - DNA, 533 bp, Homo sapiens
  misc_feature: HEFZJCU01DRSK1.51.26.C04.1.454.heavy.3.raw
  modified_base (432)..(432): a, c, t, g, unknown or other
  modified_base (525)..(525): a, c, t, g, unknown or other
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttatactgtgtgcgatccgacctcactggtacgggagttacttcctccgcaacggtntggacgtcgtgggccaagggaccacggtcaccgtctccttagcctccaccaagggcccatcggtcttccccctggccaccctccctccaagancacctctc

SEQ ID NO: 529924 - DNA, 487 bp, Homo sapiens
  misc_feature: HEFZJCU01DZVRY.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctgctccaggagcacctccgagagcacagcggcccgtgggctgcctggtcaggactactccctacagtgct

SEQ ID NO: 529925 - DNA, 493 bp, Homo sapiens
  misc_feature: HEFZJCU01BURF7.49.21.B10.1.454.heavy.3.raw
agtcgagagacacgaccggtgctcgatttagtgtcgtcgcaagggggctctgggagacgagcccagcactggaaggcgccggtgtttccattcggtgatcagcactgaacacagaggactcaccatggagtttgggctgagctgggttttcctcgttggtctttttaagaggtgtccagtgttatgtgcagttggtggagtctgggggagcgtggtccagcctgggaagtcactgagactcgcctgtacaccctctggattcaccttcagcaactatgcaatgcactggtccgcctggctcccggcaagggtctggactgggtggcaggtatatcagctgatgggaccaaaatatactacgcaaactccgtgaagggccgattcaccatatcaagagacacttccgatgacacaatctatctgcaatgaacagcctgaaagttgacgacacgggtctttttactgttgcgcctggaagcagtggctggccaca

SEQ ID NO: 529926 - DNA, 527 bp, Homo sapiens
  misc_feature: HEFZJCU01BMCMV.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgccaggctccagggaaggggctggagtgggtctcctttatttacagcaggtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacc

SEQ ID NO: 529927 - DNA, 512 bp, Homo sapiens
  misc_feature: HEFZJCU01DFJ0Y.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacgacggcgtgtttattacttgtacgaaagaggggggatacagtggcgagctccaagtacttaa

SEQ ID NO: 529928 - DNA, 503 bp, Homo sapiens
  misc_feature: HEFZJCU01ECK5A.48.71.G05.1.454.heavy.3.raw
agtatacatacacgaccggtgctcgatttagtgtcgtcgcaagagagagggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggcagcctgaagtctgaagacacgggcatattatttctgttgcgacagatggtcgtggatttcgtcgttctggtctttagtgggtaa

SEQ ID NO: 529929 - DNA, 504 bp, Homo sapiens
  misc_feature: HEFZJCU01C8G6M.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacaagggcagagtcaccattaccagggacacatccgcgaacacagcctacatggagctgagcagcctgacatctgaagacacggctgtgtattactgttcgagcgggctagtctgggatctagtttatagtgactcgtcgttcgtggggccg

SEQ ID NO: 529930 - DNA, 399 bp, Homo sapiens
  misc_feature: HEFZJCU01C85C2.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggcaccgtctcctcagcctccaccaagggcccatcggtcttccccctggcgccctgctccaggagcacctccgagagcacagcggccctgggctgcctggtcaaggactacttcctacgtgagct

SEQ ID NO: 529931 - DNA, 519 bp, Homo sapiens
  misc_feature: HEFZJCU01C6CXT.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctgggagtggatctcacttatttatagtggtggtaccacatactacacagactccgtgaagggccgattcaccatctcagaagacaattccaggtaacacattgtatcttcaaatgaataacctgagagccgaggacacggccatgtattactgtgtggggcatttacttcgaccctggggaccggggaacccgtggtctaccgtctcccc

SEQ ID NO: 529932 - DNA, 540 bp, Homo sapiens
  misc_feature: HEFZJCU01BVEZ8.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgtagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgtgtttagttggggaccaggggacgcccgtggtcaccgtt

SEQ ID NO: 529933 - DNA, 526 bp, Homo sapiens
  misc_feature: HEFZJCU01AMB4J.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctgccgcctcg

SEQ ID NO: 529934 - DNA, 508 bp, Homo sapiens
  misc_feature: HEFZJCU01DWCLW.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctgggccagggaccct

SEQ ID NO: 529935 - DNA, 499 bp, Homo sapiens
  misc_feature: HEFZJCU01DNS9O.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccat

SEQ ID NO: 529936 - DNA, 498 bp, Homo sapiens
  misc_feature: HEFZJCU01C84XI.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccatctcctcagcctccaccaaggcccatcggtcttcccctggcaccctcctccaagagcacctctgggggcacagcggccctgggctgcctggtcaaggactacttccgagtagtaca

SEQ ID NO: 529937 - DNA, 484 bp, Homo sapiens
  misc_feature: HEFZJCU01CVKZ9.48.30.C08.1.454.heavy.3.raw
agtatacatacacgaccggtgctcgatttagtctgacgtcaaagggaaaggggagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacaggcccctcgacaagggcctgagtggatggggatggatcaaccctaggtatggcagcacaagccacgcagagaagttccagggcagagttatcatgaccagcgacacgtccacgagcacagtctacatgagtctgagcagcctgagatctgaagacacggccgtctattactgtgcggaggacgggggggtgggtccc

SEQ ID NO: 529938 - DNA, 534 bp, Homo sapiens
  misc_feature: HEFZJCU01DO61U.18.39.D06.1.454.heavy.3.raw
  modified_base (498)..(498): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtccttccccctggccgccctcgcctacgacgagccacctcggtacgggcgacgcgcccggtccgcggtcncgtcgtcgtacgaaggtacctacctcctacttaccg

SEQ ID NO: 529939 - DNA, 522 bp, Homo sapiens
  misc_feature: HEFZJCU01CHCS2.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtgggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccaggggaaccctggtccaccgtctcctcag

SEQ ID NO: 529940 - DNA, 379 bp, Homo sapiens
  misc_feature: HEFZJCU01CLE5Z.2.81.H04.1.454.heavy.3.raw
  modified_base (291)..(291): a, c, t, g, unknown or other
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggttgtccagtgtgaggttgcagctggtggagtccgggggagcctgggtccagcctgggggtccctgacgactcncctgtcagcctctggatctacctttagtaggttttggatgagttcgggtccgtccgaggctccgaagggaagggctggagtgggtgcc

SEQ ID NO: 529941 - DNA, 429 bp, Homo sapiens
  misc_feature: HEFZJCU01DDMRE.4.37.D04.1.454.heavy.3.raw
agcactgtagcacgaccggtgctcgatttagtagcatactgttgggtttggggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccgagggacacgtccatcagcacgtccatcagcacagcctacatgga

SEQ ID NO: 529942 - DNA, 501 bp, Homo sapiens
  misc_feature: HEFZJCU01B14ON.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactgggggccaggggaaccctggtcaccgtctcctcagcct

SEQ ID NO: 529943 - DNA, 521 bp, Homo sapiens
  misc_feature: HEFZJCU01AGDDX.49.23.C01.1.454.heavy.3.raw
agtcgagagacacgaccggtgctcgatttagtacacgtgattagggattgggggcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaactacgcacagaagttccaggacagaatcacgataaccgcggacacatccacgagcactattttcatgaactgagcagcctcagatccgaggacacggccgtttacgtactgtgcgagcggactcccggattcccggcgtttcggaggatgactactcgggggccacgggtaacccg

SEQ ID NO: 529944 - DNA, 528 bp, Homo sapiens
  misc_feature: HEFZJCU01DZ4AE.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaacctacaacccctccctcaagagtcgagtcaccatatcaatagacacgtcgaagaaccagttctccctagaagttgaactcagtgaccgctgcggacacggccgtgtattactgtgcgagccacaccgattacgtattttggagtggccttgataactggggccgaggggatcctggtcaccgtctcctcagcctccaccaac

SEQ ID NO: 529945 - DNA, 514 bp, Homo sapiens
  misc_feature: HEFZJCU01BCDZM.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctggggccgtggcaccctggtcactgtctcctcggcttccaccaaggcccatcggtccttcccctggccgcctcgctccagacgcacctctggggcacgagtccgccc

SEQ ID NO: 529946 - DNA, 512 bp, Homo sapiens
  misc_feature: HEFZJCU01EKUBX.16.21.B10.1.454.heavy.3.raw
  modified_base (117)..(117): a, c, t, g, unknown or other
  modified_base (429)..(429): a, c, t, g, unknown or other
tgtactactccacgaccggtgctcgatttagtgtcgtcgcaagagagcggagcccagccctgggattttcaggtgttttcatttggtgatcaggactgaacagagagaactcaccanggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagccngagagccgacgacacggccatatattactgtgcgaaagcaccggcagttagtcacccatactactttgtactacgtggggccg

SEQ ID NO: 529947 - DNA, 504 bp, Homo sapiens; identical to SEQ ID NO: 455141
  misc_feature: HEFZJCU01DHVTK.17.25.C03.1.454.heavy.3.raw

SEQ ID NO: 529948 - DNA, 526 bp, Homo sapiens
  misc_feature: HEFZJCU01DUWMA.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaattccagggcagactcaccataaccgcggacaaattaacgaacacagttaatctggagctagaacagcctgtcatctgaggacgacgggcttctacttctgtgcgaggagtaattactatacactgcttcttttacacctccttgacttctgggccatcggacccgtaccg

SEQ ID NO: 529949 - DNA, 499 bp, Homo sapiens
  misc_feature: HEFZJCU01CRSUC.7.85.H08.1.454.heavy.3.raw
  modified_base (435)..(435): a, c, t, g, unknown or other
  modified_base (482)..(482): a, c, t, g, unknown or other
cgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccgaattcaccacctccagagacgaccgccaagactcactgtctctgcaatgaanagcctgagagtcgaggacacggctggtagtattacgtgtgcgagagntccgggagggacgtagt

SEQ ID NO: 529950 - DNA, 503 bp, Homo sapiens
  misc_feature: HEFZJCU01DBTDP.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagtatttactatagtaggtgacgtacggggggcgttcg

SEQ ID NO: 529951 - DNA, 507 bp, Homo sapiens
  misc_feature: HEFZJCU01C1RFX.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgtagcgcagtggtcttttgatgtccttgtactatggtgggcgaagggacaagtgtaccg

SEQ ID NO: 529952 - DNA, 508 bp, Homo sapiens
  misc_feature: HEFZJCU01CR5IO.17.25.C03.1.454.heavy.3.raw
  modified_base (418)..(418): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggngcctgacatctgacgacacggccgtctattactgtgcgagagtcccacgatccggtgacgcctacggcaggccggcctttggacttcgtc

SEQ ID NO: 529953 - DNA, 415 bp, Homo sapiens
  misc_feature: HEFZJCU01A1LRK.48.73.G07.1.454.heavy.3.raw
agtatacatacacgaccggtgctcgatttagctctacgctcagggcacgaccggtgctcgatttagtcacgcgagaaaggggctggtttgggtctcacgtatttatgctgctggagatacagcctacgcggactccgtgaagggccgattcaccatctctagagacaacgccaagaacacggtgactctgcaaatggacggtctgagggccgacgacacggctgtctactattgtgcaaaagggccgattaactcttacggtctggacgtctggggccaagggaccacggtcagcgtctcttcagcctccaccaagggcccatcggtcttccccctggcgccctgctccaggagccacctccgagagcacagcggccctgggctgcctggtcaaggactacttcctatgtatact

SEQ ID NO: 529954 - DNA, 494 bp, Homo sapiens
  misc_feature: HEFZJCU01DP7VH.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagtttacggcgtattacgacgttttga

SEQ ID NO: 529955 - DNA, 459 bp, Homo sapiens
  misc_feature: HEFZJCU01C80JK.15.28.C06.1.454.heavy.3.raw
tctacgtagccacgaccggtgctcgatttagagctcacgtattgggtttgggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggcgccctgctccacggagcacctccgagagcacagcggccctgggctgcctggtcaaggactactccgctacgtaga

SEQ ID NO: 529956 - DNA, 491 bp, Homo sapiens
  misc_feature: HEFZJCU01D2UPX.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgtattcaccatctccagagacaattccaagaacatggtgtatctgcaaatgaccagcctgagagccgagacacgggtgtttatactgtggagaaatctagtggc

SEQ ID NO: 529957 - DNA, 499 bp, Homo sapiens
  misc_feature: HEFZJCU01A8F9S.13.85.H08.1.454.heavy.3.raw
  modified_base (464)..(464): a, c, t, g, unknown or other
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttggagcagccctgagatctgacgacacggccgttttattactgtgcgcgngataatagtcacaactggaacggcgttttgggggt

SEQ ID NO: 529958 - DNA, 507 bp, Homo sapiens; identical to SEQ ID NO: 461976
  misc_feature: HEFZJCU01B5ER7.9.64.F09.1.454.heavy.3.raw

SEQ ID NO: 529959 - DNA, 502 bp, Homo sapiens
  misc_feature: HEFZJCU01BNAA6.48.34.D01.1.454.heavy.3.raw
agtatacatacacgaccggtgctcgatttagatcgtctgtgttgggtttgggcacgaccggtgctcgatttagatcgtctgtgttgggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggagtgtggtccagcctgggaagtccctgacactgtcctgcgcagcctctggattcaccttcaccacctttcgtatgcactttgtccgccaggctccgaggcaaggggctggagtgggtgctgttgtgtcaaatgatggacatgctgaatatgcagactccgtggaggggccgattcgccttctccagagacaattccaagagcacggttcatctgcaaatgagcgcccgtgagacctgacgacacggctgtctta

SEQ ID NO: 529960 - DNA, 539 bp, Homo sapiens
  misc_feature: HEFZJCU01CJMOT.19.48.E04.1.454.heavy.3.raw
  modified_base (468)..(468): a, c, t, g, unknown or other
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattgggatgaactgggcccgccaggctccggggaaggggccggagtgggtggccaacataatgcaagatggaactgaagaaaaactatggggactctgtgaagggccgattcaccatctccagagacaaccgtaagaacttactgtttctgcaaatgaacagcctgagagccgaggacacggctgtntattattgtgcgaagggcaggtggcgtgggacagtggacgtcgtgggggccaaggggaccacggtcaccgt

SEQ ID NO: 529961 - DNA, 427 bp, Homo sapiens
  misc_feature: HEFZJCU01CCUMU.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggccatcggtctccccctggcaccctcctccaagagcacctctgggggcacagcggcctgggctgccgtggtaccaggactacttccagaccgtatca

SEQ ID NO: 529962 - DNA, 504 bp, Homo sapiens; identical to SEQ ID NO: 445353
  misc_feature: HEFZJCU01DM7BO.10.38.D05.1.454.heavy.3.raw

SEQ ID NO: 529963 - DNA, 499 bp, Homo sapiens
  misc_feature: HEFZJCU01BVIDU.3.48.E04.1.454.heavy.3.raw
  modified_base (438)..(438): a, c, t, g, unknown or other
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggtcgattcatcatctccagagacaactccaacaacacactggatctccaaatgaacngacctgagagtcggaggacacggccgtatacgtttattggtcgtcccgttgactttacgta

SEQ ID NO: 529964 - DNA, 496 bp, Homo sapiens
  misc_feature: HEFZJCU01C1P8I.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggccctgggcagggacttgagtggctggggcggatcatccctaccgttgatgtggcaaactatgcacagaagttccaggggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtcgtggggccaagggagcactgtcaccgtctcctcagcctccaccaagggcccatcggtcttcccct

SEQ ID NO: 529965 - DNA, 437 bp, Homo sapiens; identical to SEQ ID NO: 444603
  misc_feature: HEFZJCU01BIZ86.3.21.B10.1.454.heavy.3.raw

SEQ ID NO: 529966 - DNA, 503 bp, Homo sapiens
  misc_feature: HEFZJCU01C1JZ6.17.10.A10.1.454.heavy.3.raw
  modified_base (462)..(462): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcaggagtcacgattaccacggacacccccacgaacacagtctacatgcaactgacgagcctgaggagctgacgacacggccgtctattactgtgcgagaatgttttcngtcatcgtacaatttgataggctctatggactggacttctc

SEQ ID NO: 529967 - DNA, 537 bp, Homo sapiens
  misc_feature: HEFZJCU01BJZWC.17.28.C06.1.454.heavy.3.raw
cgtagactagcacgaccggtgctcgatttagagctcacgtattgggtttggggaggtctcagagaggatgcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaatggctggtgtttattggggccaggggacgcccgtggtccg

SEQ ID NO: 529968 - DNA, 518 bp, Homo sapiens; identical to SEQ ID NO: 449255
  misc_feature: HEFZJCU01CF7DA.3.17.B06.1.454.heavy.3.raw

SEQ ID NO: 529969 - DNA, 563 bp, Homo sapiens
  misc_feature: HEFZJCU01AMOEX.52.14.B03.1.454.heavy.3.raw
cgcagtacgacacgaccggtgctcgatttagtgtgagtagttcccggggggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcactgtctctggtggctccatcagcagtagtgattactactggggctggatccgccagcccccagggaaggggctggagtggattgggagtgtcttttatagtggaaacacctactacaaccccgtccctcaagagtcgagtcaccgatatcagtagacacgtccaagagccagttctccctgaagctgacgtctctgaacgccgcggacacggccgtttattactgtgcgagtaccccggaactttttacgatttttggagtggatactataccggtatgggggcctttttgactttcgtggggccaggggaaccctggtccaccggtcctccttcagcctccaccgaagggcccagtcggtccttcccctc

SEQ ID NO: 529970 - DNA, 479 bp, Homo sapiens
  misc_feature: HEFZJCU01EMPLB.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcacctcctccaagagcacctctgggggcacagcggccctggctgcctggtcaaggactacttcctagagacacg

SEQ ID NO: 529971 - DNA, 528 bp, Homo sapiens
  misc_feature: HEFZJCU01B6D8V.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcacctcgggagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccaacgacacggccgtttattactgtgcgagagattcgagtgggttcggggacctcaccctggttctacttcgatctctggggccgtc

SEQ ID NO: 529972 - DNA, 516 bp, Homo sapiens
  misc_feature: HEFZJCU01CS7TU.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacaccggccatatattactgtgcgaaagcaccggcagttagtcacccatactactttcgtacttacgtggggtccg

SEQ ID NO: 529973 - DNA, 497 bp, Homo sapiens
  misc_feature: HEFZJCU01DFK10.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccaggggacacgtccacgagaacagactatttggagttgagcagcctgagatctgacgacacggccgttttatactgtgcgcgagataatagtcacaactggaacggcggttttggggg

SEQ ID NO: 529974 - DNA, 513 bp, Homo sapiens
  misc_feature: HEFZJCU01AYJ5K.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagtttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 529975 - DNA, 334 bp, Homo sapiens
  misc_feature: HEFZJCU01ALRYF.51.26.C04.1.454.heavy.3.raw
cgatcgtatacacgaccggtgctcgatttagtctagcgactttgggtttggggcaggggaggggggctaaggtgaggcaggtggcgccagccaggtgcacacccaatgcccatgagcccagacactggacgctgaacctcgcggacagttaagaacccaggggcctctgcgccctggcccagctctgtcccacaccgcggtcacatggcaccacctctcttgcagcctccaccaagggcccatcggtcttccccctggcaccctcctccaagagcacctctgggggcacagcggccctgggctgcctggtcaaggactacttcctcgtagcact

SEQ ID NO: 529976 - DNA, 521 bp, Homo sapiens
  misc_feature: HEFZJCU01CY6D6.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaaatgtatttggagctgaacagcctaagtcctgaggacacgggcgtagtactactgtacgaaggaggggggaaccaggcgggagttccgaagtactcctttgacgtctc

SEQ ID NO: 529977 - DNA, 504 bp, Homo sapiens
  misc_feature: HEFZJCU01DV014.17.10.A10.1.454.heavy.3.raw
  modified_base (484)..(484): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcaacagtatgcaccgaagatgaaagggcagagtcacgattaccacggacacccccacgaacacagtctacatgcaactgacgagcctgagagctgacgacacggccgtctattactgtgcgagaatgttttctgtcatcgtacaatttgataggntctatggactggacttcgtc

SEQ ID NO: 529978 - DNA, 508 bp, Homo sapiens
  misc_feature: HEFZJCU01B4SL2.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagtttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcgtggggccagggaccg

SEQ ID NO: 529979 - DNA, 503 bp, Homo sapiens
  misc_feature: HEFZJCU01D26B3.51.7.A07.1.454.heavy.3.raw
cgatcgtatacacgaccggtgctcgatttagcacgtgtcgcaggggtccgggagaggagcccagcactagaagtcggcggtgtttccactcggtgatgagcactgaacacagaggactcaccatggagtttgggctgagctgggttttcctcgttgctcttttaagaggtgtccagtgtcaggtgcacctggtggaatctgggggaggcgtggtccagcctgggaggtccctgagactctcttgtgtaggctctggattcagcttcagcaactatggcatgcactgggtccgccaggccccaggcgaggggctgcagtgggtggcagttatatcgtctgatgcaagtaatgaacattatggagaatccgtgaagggccgattcaccatctccagagacaattccaggaacacggtgtttctgcaaatgaacaggctgactacctgaaggacacggctgtactattattgtgtgaagggtcccgtgaactaacttcggatactt

SEQ ID NO: 529980 - DNA, 504 bp, Homo sapiens
  misc_feature: HEFZJCU01AMLZN.48.29.C07.1.454.heavy.3.raw
agtatacatacacgaccggtgctcgatttagagtgctacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaggactacttctatgtatact

SEQ ID NO: 529981 - DNA, 543 bp, Homo sapiens
  misc_feature: HEFZJCU01DVNZA.53.64.F09.1.454.heavy.3.raw
cgcgtatacacacgaccggtgctcgatttagcgcgtatacaagggggagagaggagcccagcccctgggattttcaggtgttttcatgtggtgatcaggactgaacagagagaactcaccatggagtctgggctgacgtggctttttcttgtggctattttaaaaggtgttccagtgcgacgtgcagctggtggagtcgggggggaggcttggtacagccgggggggtccctgagactctcctgtagagtctctggcttcacctttggagtctatgacatgagttgggtccgccaggctccggggaaggggctggagtgggtctcaacgatcagtgatagcggaagtaccacaaactacgccgcctccgtgaagggccgatgcaccgtctccagagacaattcgaaggactaactttatatctgcaacttcaacagactgacaaccgctgacacgggccgtctattactgtgtacaaagaagacggaccgctggacgaggacgccaggaaggaaaatcaactactttgactacgtggggccaa

SEQ ID NO: 529982 - DNA, 519 bp, Homo sapiens
  misc_feature: HEFZJCU01D856N.40.9.A09.1.454.heavy.3.raw
tctagcgactcacgaccggtgctcgatttagcgagacgcgcagggggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccattccagagacaacgccaagaagtcactctctctacacatgaccagcctgacagccgaggacacggctgtttattactgtgcgagagatgggcacgtcgggggcggtgacttttgacgtactggggccaggg

SEQ ID NO: 529983 - DNA, 511 bp, Homo sapiens
  misc_feature: HEFZJCU01BUWBB.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcacgaagatgaagggcagagtcacgattaccacggaccacccccacgaacacagtctacatgcaactgacgagcctgagagctgacgacacggcctctattactgtgcgaagaattgttttctgtcattcgtacaattttgatagggcttctatcggactggtaccttcgtac

SEQ ID NO: 529984 - DNA, 507 bp, Homo sapiens
  misc_feature: HEFZJCU01DJV0Q.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagagggagctattatctacggaaccccgatgtt

SEQ ID NO: 529985 - DNA, 502 bp, Homo sapiens
  misc_feature: HEFZJCU01EGA08.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctcaccaagggcccatcgatcttcccctggcaccctcctccaacgagcacctctgggggcacagcggccctgggctgcctggtcaggactacttccgctacgtaga

SEQ ID NO: 529986 - DNA, 519 bp, Homo sapiens
  misc_feature: HEFZJCU01EV0L6.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtggcgtttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggtccggttcaccatctccagagacaattcaagaacacactgtatctgcaaatgaacagcctgagagccgacgacacggccatactattactgtgcgaaagcgaccggcagttagtcacccatactactttgactacgtcggggaccg

SEQ ID NO: 529987 - DNA, 542 bp, Homo sapiens
  misc_feature: HEFZJCU01EBARL.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatcgaccgttggagtcgagggaactctggtcaccgtctcctcacgcctccaccaacgggcccaatccggtcctttcccccgtcggccgcccgtgcctcccacggacgccaccctccgacgagccaacgacgcgggccccgtgggcgtccg

SEQ ID NO: 529988 - DNA, 530 bp, Homo sapiens
  misc_feature: HEFZJCU01DUT2V.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcaggtggctggtccacgtaggtttgactactgggggaccaggggaagcgttggtcaccgtctcctcagcctcccg

SEQ ID NO: 529989 - DNA, 501 bp, Homo sapiens
  misc_feature: HEFZJCU01BEZ4E.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctgggagtgggtggcagttatttcatatgatggaaatagtgacttctattcagactccgtgaagggccgattcaccgtctccagagacaattccaggcacacgctgtatctgcaaatgaaacagcctgagagctgaggacacggctgtgtattactgtgcgaaagatttctatagaggtgacgtacgggggcgttcg

SEQ ID NO: 529990 - DNA, 536 bp, Homo sapiens
  misc_feature: HEFZJCU01ETLRT.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattatgtgcgagcggcaaatatggttcagggtagttcgacgtactggggggcctaggggagcccgttggtcctaccggtccttcctcacgtcctccaacccaaacc

SEQ ID NO: 529991 - DNA, 529 bp, Homo sapiens
  misc_feature: HEFZJCU01D4TPE.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacagggcggtttgtcttctccatggatacctctgtcgggacggcttatctgcagataaccaaccttcaacctgacgacactgccgtttatttttgtacgagagcgtcgtctgtcagtggaattgactacgtggggccagggaaccctggtcaccgtctcctcagcctccacc

SEQ ID NO: 529992 - DNA, 512 bp, Homo sapiens
  misc_feature: HEFZJCU01BUAZC.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagcggcctttgacttctgggggccaggggtacg

SEQ ID NO: 529993 - DNA, 509 bp, Homo sapiens; identical to SEQ ID NO: 454842
  misc_feature: HEFZJCU01A1NCI.2.33.C11.1.454.heavy.3.raw

SEQ ID NO: 529994 - DNA, 537 bp, Homo sapiens
  misc_feature: HEFZJCU01EBZ3R.16.86.H09.1.454.heavy.3.raw
  modified_base (502)..(502): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaaggcctggagtggattgggaacatctattacagcgggagcaccaactacaacccgtccctcaagagtcgagttaccatttcattaaacacgtctaagaaccagttctccctagaagctgacctttgtgactgccgcggacacggccgtgtattactgtgcgagagacccctcgatagcaagtggctggtccacgttaggtttgactacgtggggaccaggggaancgtttggtaccaccggtctcctccagtcctacccg

SEQ ID NO: 529995 - DNA, 504 bp, Homo sapiens
  misc_feature: HEFZJCU01BSWOQ.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaattatgcacaggagtttcggggcagggtcgtcatgaccggggacacgtccatcgccacggacttacatggaactgaccagtctgacatttgacgacacggccgtctattactgtgcgacagaagcggcggacagaggttcgcttactggttcgagg

SEQ ID NO: 529996 - DNA, 494 bp, Homo sapiens
  misc_feature: HEFZJCU01B3FI9.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccttgaagggccgattcaccatctccagagacaattccaagaacacgcagtatctgcaaatgaacagcctgagagctgaggacacggctgtgtattactgtgggagagatggaggtcgatattgta

SEQ ID NO: 529997 - DNA, 504 bp, Homo sapiens
  misc_feature: HEFZJCU01D6AOY.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctatttttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcacctatcctccagagacaattccaagaacacactgtatctgcaaatgaacagcctgagacgccgacgacacggccatatattactgtgcgaaagcaccggcagttagtcacccatactacttgactct

SEQ ID NO: 529998 - DNA, 492 bp, Homo sapiens
  misc_feature: HEFZJCU01AWQCK.22.86.H09.1.454.heavy.3.raw
  modified_base (438)..(438): a, c, t, g, unknown or other
acatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctcaatgaacagctgagngacgaggacacggcagtgtattacgtgtgcgagagatcgacatcgacgtacggg

SEQ ID NO: 529999 - DNA, 409 bp, Homo sapiens; identical to SEQ ID NO: 444519
  misc_feature: HEFZJCU01CPMHX.3.41.D08.1.454.heavy.3.raw

SEQ ID NO: 530000 - DNA, 499 bp, Homo sapiens
  misc_feature: HEFZJCU01BQ0RR.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcgaggacacggctgtatattattgtgcgagagccccctaggtcgtacg

SEQ ID NO: 530001 - DNA, 515 bp, Homo sapiens; identical to SEQ ID NO: 472323
  misc_feature: HEFZJCU01EEIK9.19.67.G01.1.454.heavy.3.raw

SEQ ID NO: 530002 - DNA, 544 bp, Homo sapiens
  misc_feature: HEFZJCU01EG20L.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagcctttcggagaccctgtccctcacctgcgctgtgtccggtttctccatcagtagtgggcattattggggctggatccggcagcccccagggaaggggctggagtggattgggagtatctatttttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaactactttttttgactattggggccagggaatcctggtcaccgtcgccttcagtccctccaccgaacgggcccacgtcgtcctttcccccg

SEQ ID NO: 530003 - DNA, 507 bp, Homo sapiens
  misc_feature: HEFZJCU01CSWTK.51.81.H04.1.454.heavy.3.raw
cgatcgtatacacgaccggtgctcgatttagtagtgtagattcgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatggatggtttagtctgagaactggtgccgcaaattatgcacaggagtttcggggcaggggtcatcatgacggggacacgtccatcgccacaacttacatggaactgaccagtctgacatttgacgacacggccgtctattactgtgcgacagaagcggcggacagaggttcgcttactggtcgaggctctcccctac

SEQ ID NO: 530004 - DNA, 514 bp, Homo sapiens
  misc_feature: HEFZJCU01DB6D0.48.81.H04.1.454.heavy.3.raw
  modified_base (351)..(351): a, c, t, g, unknown or other
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagngattccagggcagaatcacacttaccgcggacaaatccacgggcacagcgcagttggacctgagcggcctgagacctgaggacacggccatttacactgtgcggcgggggaggtggacggagctcgggttttcggagtttatcatctactctttagtaattcc

SEQ ID NO: 530005 - DNA, 504 bp, Homo sapiens
  misc_feature: HEFZJCU01D0C7E.51.78.H01.1.454.heavy.3.raw
cgatcgtatacacgaccggtgctcgatttagtgtgagtagtttggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatggcggactctgtgaagggccgattcaccatctccagagacaacgccaagaactccctgtatctgcaaatgaacagtctgagagctggaggacacggccttagtattactgccgactaaaagccgaaggcaacagc

SEQ ID NO: 530006 - DNA, 520 bp, Homo sapiens
  misc_feature: HEFZJCU01DWU4M.22.86.H09.1.454.heavy.3.raw
acatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctccaaatgaacagcctgagaggcgaggacacggcagtgtattactgtgcgagagatcgacatgactacgggaaagcttttgatctctgggccaagggacactggtcaccgtctcttcagcctcccaccaacgggcccagtccggtccttcccccgtcggccggccctcgccgtcccgaggac

SEQ ID NO: 530007 - DNA, 493 bp, Homo sapiens
  misc_feature: HEFZJCU01BLDPF.49.48.E04.1.454.heavy.3.raw
agtcgagagacacgaccggtgctcgatttagagagcgtcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaaggggcttgagtggatgggaatatcaaccctagtggtggtagcacaacctccgcacagaggttccagggcagagtcaccatgaccagggacacgtccacgagcacattctacatggaactgagccgcctgagatctgacgacacggcctgtactactgtgcgagagtcactcattactacgatagttatgggtcg

SEQ ID NO: 530008 - DNA, 521 bp, Homo sapiens
  misc_feature: HEFZJCU01EIM0Z.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccaggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgacctggttattaccg

SEQ ID NO: 530009 - DNA, 533 bp, Homo sapiens
  misc_feature: HEFZJCU01EQ6YR.2.85.H08.1.454.heavy.3.raw
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcacctttcaggacctatattatgacctgggtgcgacaggcccctggacaagggcttgagtggctgggggggatcgatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgatttatttgaatttcggacttcctacctacttacggtatgggacgtctgggggtaccagggggaccgacggtcacccgtctcttcg

SEQ ID NO: 530010 - DNA, 504 bp, Homo sapiens
  misc_feature: HEFZJCU01D36AX.19.26.C04.1.454.heavy.3.raw
tactctcgtgcacgaccggtgctcgatttagtctagcgactttgggtttgggggagaggagcccagcactagaagtcggcggtgtttccattcggtgatcagcactgaacacagaggactcaccatggagtttgggctgagctggggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagacctccgtgaagggccgattcaccatctccagagacaattccaagaacacagtggatctgcaaatgaacagcctgagagcgtgggggacacggctgtgtattactgtgcgagagcggctggcaactacatccatttac

SEQ ID NO: 530011 - DNA, 522 bp, Homo sapiens
  misc_feature: HEFZJCU01BEWUS.4.57.F02.1.454.heavy.3.raw
  modified_base (347)..(347): a, c, t, g, unknown or other
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctganagccgaggacacggctgtctattattgtgcgagagtaagtggtcatggtcttttgaccagtggggccagggaaccctggtcaccgtctcctcagcttccaccaagggcccatcggtcttccccctggcgccctgcctccaggacgcacctcgtgggggtcaccgagccggtcccc

SEQ ID NO: 530012 - DNA, 497 bp, Homo sapiens
  misc_feature: HEFZJCU01DC7YD.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttcggggggacgac

SEQ ID NO: 530013 - DNA, 539 bp, Homo sapiens
  misc_feature: HEFZJCU01CU7CF.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattccaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaggcagttcgtaggaacagttagtgggttggggggaggtttgggtttttttttacggtttacgttacgggattc

SEQ ID NO: 530014 - DNA, 526 bp, Homo sapiens
  misc_feature: HEFZJCU01AI5M2.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggcccttcacggggcggtttgtcttctccatggatacctctgtcgggacggcttatctgcagataaccaaccttcaacctgacgacactgccgtttattttgttacgagagcgtcgtctgtcagtggaattgactacgtggggccagggaaccctggtcaccgtctcctcagcctcc

SEQ ID NO: 530015 - DNA, 491 bp, Homo sapiens
  misc_feature: HEFZJCU01D15RC.19.53.E09.1.454.heavy.3.raw
  modified_base (444)..(444): a, c, t, g, unknown or other
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgattgattatgccatgcactgggtccggcaagctccagggaagggcctggagtgggtctcaggtattagttggaatagtgctagtatagcctatgcggactctgtgaagggccgattcaccatctccagagacaacgccaaagaactccctgtatctgcaaatgaacagtctgagancttgaggacacgggccttgtattactgttgacgtaagggaggtaata

SEQ ID NO: 530016 - DNA, 533 bp, Homo sapiens
  misc_feature: HEFZJCU01ASAL0.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctacaaaagtcgaggcaccatatccgtagacacgtccaagaaccaattctccctgaagctgagctctgtgaccgccgcagacacggctgtctattactgtgcgacggccccgaggccgcagtggtcgtttttgattcgtcctttgtacttaattggtgggggtccgaaggggacctaaagtcggtcgtacccggtt

SEQ ID NO: 530017 - DNA, 563 bp, Homo sapiens
  misc_feature: HEFZJCU01EA3IW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcggagagagacacacgaacctactggccaatactagtgggggcttgtttctgggggccagggggaccccttgggctagtccgtccgtcccccagcccttcccaacccaacgggggaccccagtccgggttccttcccccgttcgggccgtcccctcg

SEQ ID NO: 530018 - DNA, 511 bp, Homo sapiens
  misc_feature: HEFZJCU01AV268.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagagggaagtgggatattgtggcagctcgaggtgcccagcccggggcccctactttcgactacgtc

SEQ ID NO: 530019 - DNA, 498 bp, Homo sapiens
  misc_feature: HEFZJCU01CP42Q.17.10.A10.1.454.heavy.3.raw
cgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacatttgataggctctatggatggacttctc

SEQ ID NO: 530020 - DNA, 536 bp, Homo sapiens
  misc_feature: HEFZJCU01CMYEQ.48.56.F01.1.454.heavy.3.raw
agtatacatacacgaccggtgctcgatttagcagacgtctgaacacacaaagggggagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagccccaagaacacactgtctctggagatgatcaacctgagagccgacgacacggcagtgtattactgcgcgaaagaaatcaagtgggactcatctcgggcggccgacccacgtggggccacgggtaacccg

SEQ ID NO: 530021 - DNA, 508 bp, Homo sapiens
  misc_feature: HEFZJCU01BE1RN.4.81.H04.1.454.heavy.3.raw
agcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagagactttgacatgaattgggtccgccaggctccagggaaggggctggagtgggtctcatccatcagttccagtactcgttacatactactacgcagactcagtgaggggccgattcaccatctccagagacacgccaagaactcagtgtttctgcaaatgaacagcctgagagtcgaggactcggctgtctactactgtgcgaggaagtaagggagctaccctacgtatttgga

SEQ ID NO: 530022 - DNA, 508 bp, Homo sapiens
  misc_feature: HEFZJCU01A6AYO.8.38.D05.1.454.heavy.3.raw
  modified_base (423)..(423): a, c, t, g, unknown or other
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgnaaatggacagcctaagagttggaggacacggctgtttattactgtacgaaagaggggggatacgagtggacgagactccaagtac

SEQ ID NO: 530023 - DNA, 507 bp, Homo sapiens
  misc_feature: HEFZJCU01EYPJ8.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtagttccggggggacgacatgacacc

SEQ ID NO: 530024 - DNA, 398 bp, Homo sapiens
  misc_feature: HEFZJCU01DICZM.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcacccgtctccacagcctccaccaagggcccatcggtcttccccctggcgccctgctccaggagcaccctccgagagcacagcggccctgggctgcctggtcaaggactacttcctacgtgagct

SEQ ID NO: 530025 - DNA, 506 bp, Homo sapiens
  misc_feature: HEFZJCU01CNEL0.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatggggatggatcagcgcttacaatgggaacacaaactatgcacagacgttccagggcagagtcaccattaccacagacacatccacgagcacagcctacatggacctgaggagcctgagatttgacgacaccggccgatagtattactgtgcgagagattgggccgacggaaaccttgactacgtggggccagggaaccc

SEQ ID NO: 530026 - DNA, 485 bp, Homo sapiens
  misc_feature: HEFZJCU01EZXUG.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatagcaccatctgttgagagtcgactgacaatcaacgtagacacatcgaagaaccagttctccctgcagctgacctctgtgactcccgaggacacgggtgtatattactgtggaagaggccccataacg

SEQ ID NO: 530027 - DNA, 526 bp, Homo sapiens
  misc_feature: HEFZJCU01D9LDK.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcacgggcccctcccacactcggtttacttttcttttgaccttcccgtcggggggtcccacggggtaaaccccttggggttccacccggttccttccctaccg

SEQ ID NO: 530028 - DNA, 517 bp, Homo sapiens
  misc_feature: HEFZJCU01BWV86.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagtgcttaccaagttggctacacaaattatgcacagaaagttccaggacagagtcaccatgaccacagacacatccacgagcacacgcctacatggaactgaggagcctgagatctgacgacacggccgtatatttctgtcgcgagagacgtaaaaggtagacggtggtagttccggggggacgtacgatggactacc

SEQ ID NO: 530029 - DNA, 507 bp, Homo sapiens
  misc_feature: HEFZJCU01BHFAN.22.86.H09.1.454.heavy.3.raw
  modified_base (492)..(492): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcgttcagcctccaccaaggcccatcggtcttcccctggcnccctgctccaggacg

SEQ ID NO: 530030 - DNA, 521 bp, Homo sapiens
  misc_feature: HEFZJCU01DSATC.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaaggccgattcaccatctccagagacaattccaagaacacgctgtttctgcaaatgagcagcctgaagaagaggacgacggctgtagtactaactgtcgcgcgaggaccttattatttatggttctaggggacctattcgactacgtgggggaccgacggggaaccctggtcaccgtctcctcacgtcctccaaccg

SEQ ID NO: 530031 - DNA, 510 bp, Homo sapiens
  misc_feature: HEFZJCU01ATNHN.48.82.H05.1.454.heavy.3.raw
  modified_base (203)..(203): a, c, t, g, unknown or other
agtatacatacacgaccggtgctcgatttagtcgagctctctcgcgggcacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcncaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccggcggacacggctgtgtattactgtgcgagacgaatgggcgggtggctacgacttgtacgttttggggccg

SEQ ID NO: 530032 - DNA, 522 bp, Homo sapiens
  misc_feature: HEFZJCU01BLTS1.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagttcccagactccgggtgacgtccgtaacggccaggccgggtcccttttggaacctttcggtc

SEQ ID NO: 530033 - DNA, 507 bp, Homo sapiens
  misc_feature: HEFZJCU01CWXC2.10.38.D05.1.454.heavy.3.raw
  modified_base (442)..(442): a, c, t, g, unknown or other
  modified_base (469)..(469): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtcgtcagttattgaaacagatggcactacatattattctgactccgtgaaggggccgttcgaccctctccagagacacttccaacaacatcttgtatcttcacatgcacaatctganagtcgacgacacggccacctattattntgcgcgacatgactacgctcaatctggggccagggacg

SEQ ID NO: 530034 - DNA, 538 bp, Homo sapiens
  misc_feature: HEFZJCU01ENPG1.14.57.F02.1.454.heavy.3.raw
  modified_base (489)..(489): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtcttggggccaagggacgctggtcaccgtctcttcagcctccaccaaggcccancggtctcccctggcacctcctccaagagcacctctcgggggcacgagcc

SEQ ID NO: 530035 - DNA, 504 bp, Homo sapiens; identical to SEQ ID NO: 459304
  misc_feature: HEFZJCU01BK68O.10.38.D05.1.454.heavy.3.raw

SEQ ID NO: 530036 - DNA, 529 bp, Homo sapiens
  misc_feature: HEFZJCU01CQG25.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgtacttcgtcgggccatcggaaccccggt

SEQ ID NO: 530037 - DNA, 520 bp, Homo sapiens
  misc_feature: HEFZJCU01A6GVG.13.61.F06.1.454.heavy.3.raw
tcacgtactacacgaccggtgctcgatttagctacgctctaagggaaagggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttcccctggccgccctgctccaggagcacctcgtgggggccacagccggccctgggctgcctgtcaaggactacttcctagtacgtga

SEQ ID NO: 530038 - DNA, 536 bp, Homo sapiens
  misc_feature: HEFZJCU01DINO2.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagagacaattccaggaacacattgtatcttcaaatgaataacctgagagccgaggacacggccatgtaattactgtgtggggctatttacttgacccctgggggaccggggaacccgtggtcaccgtcctccccaccctccaaccg

SEQ ID NO: 530039 - DNA, 518 bp, Homo sapiens
  misc_feature: HEFZJCU01ELPML.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatgaccgccgcagacacggccgtgtattactgtgcgagagaggccgtttattttaggaccagctagttaaaaactcctactacggtctggacgtcgtggggccaggggacc

SEQ ID NO: 530040 - DNA, 437 bp, Homo sapiens; identical to SEQ ID NO: 444603
  misc_feature: HEFZJCU01BIL5F.3.21.B10.1.454.heavy.3.raw

SEQ ID NO: 530041 - DNA, 497 bp, Homo sapiens
  misc_feature: HEFZJCU01EG5TJ.3.71.G05.1.454.heavy.3.raw
  modified_base (446)..(446): a, c, t, g, unknown or other
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaacgaactccctgtatctgcaatgaacagtctganacctgaggacacggccttggtattactgtgtaagtcccgggaaatatgtac

SEQ ID NO: 530042 - DNA, 489 bp, Homo sapiens
  misc_feature: HEFZJCU01CRWVV.3.48.E04.1.454.heavy.3.raw
  modified_base (435)..(435): a, c, t, g, unknown or other
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcaggtgggtggcgtttattcgaagcgatgggactcatgaacaatatgcagactccgtgaagggccgattcatcatctccagagacaactccaacaacacactggatctccaaatnaacagcctgagagtcgaggacacggccgtatattattgtgcccttgatttacta

SEQ ID NO: 530043 - DNA, 542 bp, Homo sapiens
  misc_feature: HEFZJCU01C30BD.13.28.C06.1.454.heavy.3.raw
tcacgtactacacgaccggtgctcgatttagagctcacgtattgggtttggggctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaatggagagcctgagagccgaggacacggctgtatattattgtgtgagacttagcgcactacttttgactaacgtggggcctaggggaaccctgggtactaccggtcttcccg

SEQ ID NO: 530044 - DNA, 533 bp, Homo sapiens
  misc_feature: HEFZJCU01CJGXG.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggagcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgacttatcgggggccggggacgccccgggtcactcgtcttccg

SEQ ID NO: 530045 - DNA, 513 bp, Homo sapiens
  misc_feature: HEFZJCU01A6LYQ.19.67.G01.1.454.heavy.3.raw
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacattctacggagactccatggagggccgattcaccatctccagagacttttctcagaacacactgtctctcaaatgaacagcctgagggccgaggacacggccgtctattattgtgtgagagttttatggcgatggctgggtggacaggatcgactc

SEQ ID NO: 530046 - DNA, 510 bp, Homo sapiens
  misc_feature: HEFZJCU01DIDYX.17.33.C11.1.454.heavy.3.raw
  modified_base (498)..(498): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaacccaggtggtccttacaatgaccaatatggaccctgtggacacagccacatattactgttcacgctctatggttcggggagttattagtccctacttgactactggggccagggactctggtcacgtctccgcagccnccaccaaggccc

SEQ ID NO: 530047 - DNA, 379 bp, Homo sapiens; identical to SEQ ID NO: 444450
  misc_feature: HEFZJCU01CIFE9.47.77.G11.1.454.heavy.3.raw

SEQ ID NO: 530048 - DNA, 541 bp, Homo sapiens
  misc_feature: HEFZJCU01BXB2Z.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagaatccggcccataactggctcggcccctcggggcccgggaacccgtcggtcaccgtctcctcagcctccaccaagggcccatcggtcttcccctggcaccctcctccaacgacg

SEQ ID NO: 530049 - DNA, 535 bp, Homo sapiens
  misc_feature: HEFZJCU01AIEAJ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacaacgaacctactggccatactatgggggcttgttctggggcgacggggaccctaggtcatcgtctccccgagccctccaccaacgggcccatccggtcttccccctggccgccctcg

SEQ ID NO: 530050 - DNA, 502 bp, Homo sapiens
  misc_feature: HEFZJCU01CFTB5.53.52.E08.1.454.heavy.3.raw
cgcgtatacacacgaccggtgctcgatttagtcgagctctcagagagaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtccgggggaggcgtggtccagcctgggaggtccctgagactctcctgtgtagcctctggattcaccttcagggtctatggcatgaactgggtccgccagactccaggcaagggctggagtgggtggcatttatatcatttgatggcactaataaatactatgcagactccgtgagggccgattcaccatctccagagacaattccaagaagatggtgtttctgcaaatgaacagcctgagagttgaagacacggctgtgtattactgtgcgaaacgatgagtggaactagggtcg

SEQ ID NO: 530051 - DNA, 512 bp, Homo sapiens
  misc_feature: HEFZJCU01AO6WR.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgtaatactggggccagggaaccctggtcgtccg

SEQ ID NO: 530052 - DNA, 387 bp, Homo sapiens
  misc_feature: HEFZJCU01BQ2FG.51.51.E07.1.454.heavy.3.raw
  modified_base (253)..(253): a, c, t, g, unknown or other
cgatcgtatacacgaccggtgctcgatttagcatactctacaacacacaaagggggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcncagggaccacggtcgccgtctcttcagcctccaccaagggcccatcggtcttcccctggcaccctcctccaagagcacctctggggcacagcggccctgggctgcctggtcaaggactacttcctcgtagcact

SEQ ID NO: 530053 - DNA, 494 bp, Homo sapiens
  misc_feature: HEFZJCU01DGD6U.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggaccgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaaccacggtctaatctgcacctgaccagcctgagaactgacgacacgtctctctactactgtgcgagagtagtgacgagt

SEQ ID NO: 530054 - DNA, 510 bp, Homo sapiens
  misc_feature: HEFZJCU01EK2BF.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgagggccgattcagcatctccagagacaacggcaagaggtatactgtatctggaaatgaacaatctgagagtcgacgatacgctgtctatcattgtgtttcatgccttcggtccgcgggtacttcgtggggccagggaacccgtc

SEQ ID NO: 530055 - DNA, 504 bp, Homo sapiens
  misc_feature: HEFZJCU01ETD2D.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctagtgtattactgttgcgaaagactttctatagaggtagacgtacggggggcgttcg

SEQ ID NO: 530056 - DNA, 500 bp, Homo sapiens
  misc_feature: HEFZJCU01D6UIH.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccggtgaagggccgattcaccatctccagagacaattccaagaacacgcagtatctgcaaatagaacagcctgagagctgaggacacggctgtgttattactgtgggagagagtggaggtcgatattgta

SEQ ID NO: 530057 - DNA, 523 bp, Homo sapiens
  misc_feature: HEFZJCU01CS75S.9.43.D10.1.454.heavy.3.raw
tgatacgtctcacgaccggtgctcgatttagactagcagtaaggggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgtagacatgacttcggtgaccccgtggggccagggaaccctggtccaccgtctcctcag

SEQ ID NO: 530058 - DNA, 440 bp, Homo sapiens
  misc_feature: HEFZJCU01AR37G.47.85.H08.1.454.heavy.3.raw
agctcacgtacacgaccggtgctcgatttagtatcactcagtcggggggaggcgtggtccagcctgggacgtccctcgagactctcctgttgcagcctctggcttcaccttcaataattatgctatgcagtgggtccgccgaggctccaggcgtaacggggcttagagttgggtggcggtcatatcgtccagtggacagtcttcagttagttacggcaggacctccctggacggggccgattcaccatctccagagacaattcccagaacacggtctgtctgcacctgaccagcctggagaactggacgacacgtctcgtctacctactgtgacgagagtagttgaacgagtctattgtgagcttagactcctggggccagggaaccctggtcatcgtctcctcagcctccacaagggccatcggtcttccccgtggccg

SEQ ID NO: 530059 - DNA, 532 bp, Homo sapiens
  misc_feature: HEFZJCU01CVJR9.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggcttattatggttacggggtagatcccagttggtttgtattatatagggggccgagggggacgagcggtcaccgtcttcttc

SEQ ID NO: 530060 - DNA, 504 bp, Homo sapiens; identical to SEQ ID NO: 469654
  misc_feature: HEFZJCU01DMICV.17.25.C03.1.454.heavy.3.raw

SEQ ID NO: 530061 - DNA, 504 bp, Homo sapiens; identical to SEQ ID NO: 470847
  misc_feature: HEFZJCU01CSA96.17.78.H01.1.454.heavy.3.raw

SEQ ID NO: 530062 - DNA, 534 bp, Homo sapiens
  misc_feature: HEFZJCU01BDR94.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatactgagctgaacagacctgtcatctgaggacacgggcttctacttctgtgcgaggagtaatactataacactgctccttttacacctcccttgacttctcgggtccgatcggaaccccggtcaccgtcc

SEQ ID NO: 530063 - DNA, 492 bp, Homo sapiens
  misc_feature: HEFZJCU01EMRGA.49.11.A11.1.454.heavy.3.raw
  modified_base (361)..(361): a, c, t, g, unknown or other
agtcgagagacacgaccggtgctcgatttagctacgactgcaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtanactccgtggaagggccgattcatcatctccagagacaattccgagaacagctgtatctgcaaatgaacagcctgagaagctgaggacacggctgtgtattactgtgcgtaacttaatcgacggaggtaacg

SEQ ID NO: 530064 - DNA, 303 bp, Homo sapiens
  misc_feature: HEFZJCU01EIRYC.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagcgtggtttccgttgttagctattttaaaaggtgcccagtgtgaggtgcagctggtggagtctggaggaggcttgatccagcctggggggtccctgagactctcctgtgcagcctctgggttcacgtcagtcacacctacatgagctgggtccgccaggctccagggc

SEQ ID NO: 530065 - DNA, 487 bp, Homo sapiens
  misc_feature: HEFZJCU01EKZ0U.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccgatagacatcgccacctccgtctctcggtgcta

SEQ ID NO: 530066 - DNA, 537 bp, Homo sapiens
  misc_feature: HEFZJCU01BK3E2.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggtcttgttcgtggggccgacgggggaccctggtcatcgtctccccagcctccaccaagggcccagtcggtccttccccctggccgcccgtcg

SEQ ID NO: 530067 - DNA, 498 bp, Homo sapiens
  misc_feature: HEFZJCU01B6GW6.11.71.G05.1.454.heavy.3.raw
  modified_base (421)..(421): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatnaacagcctgagagctgaggacacggctgtgtattactgtgcgaaagatttcatagaggtgaacgtcgggggcgttcg

SEQ ID NO: 530068 - DNA, 522 bp, Homo sapiens
  misc_feature: HEFZJCU01CXK0U.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacgacggggtgtatactactgtacgaagggaggggggaaccaggcgggagttccaagtactcctttgacgtctggggccgtac

SEQ ID NO: 530069 - DNA, 506 bp, Homo sapiens
  misc_feature: HEFZJCU01DZ0MD.52.81.H04.1.454.heavy.3.raw
cgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaaacagcctgagagccgaggacacggccacctatttctgtaacgaaagaatacacacagctggacgaggagaccg

SEQ ID NO: 530070 - DNA, 518 bp, Homo sapiens
  misc_feature: HEFZJCU01C7FKQ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctggctgcctggtcaaggacctactcctagagacacg

SEQ ID NO: 530071 - DNA, 503 bp, Homo sapiens
  misc_feature: HEFZJCU01B2A90.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagccgtggggggtccctgagactctcctgtgcagcctctggatttaccttcagtacttatggcatgaactgggtccgccaggctccagggaaggggctgcaggtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcgagagatccgggaggggacgtatgacc

SEQ ID NO: 530072 - DNA, 537 bp, Homo sapiens
  misc_feature: HEFZJCU01D9JX9.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccggtgaagggccgattcaccatctcagaagacaattccaggaacacattgtatcttcaatgaataacctgagagccgaggacacggccatgtattactgtgtgggggcatttacttgaccccgtgggggccgggggaacccgtggtcgaccgtctccccaccctccaacccg

SEQ ID NO: 530073 - DNA, 528 bp, Homo sapiens
  misc_feature: HEFZJCU01C3HP2.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctctttttatttatagtagttggtagtacatactccgcagactccgtgaggggccgattcaccatctccagagacaattccaagaacacgctgtttcttcaaatgaacagcctgagagccgatgacacggccgtgtattactgtgcgaggagagtgggggcccacggaaccgttactacgctagtggacgttctcgggggccgaaac

SEQ ID NO: 530074 - DNA, 529 bp, Homo sapiens
  misc_feature: HEFZJCU01C77MU.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttgataaactgggggtcccgagggggatcccgtggtccgaccgtctccctcacgcct

SEQ ID NO: 530075 - DNA, 494 bp, Homo sapiens
  misc_feature: HEFZJCU01D3DBA.12.2.A02.1.454.heavy.3.raw
  modified_base (445)..(445): a, c, t, g, unknown or other
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgacacagacacatccacgagcacagcctacatggagctgaggagcctggagatctgacgacacggccgtgtattactgngtcgagtaggttttagtgattacttattgtagtggtggtacctgcttac

SEQ ID NO: 530076 - DNA, 509 bp, Homo sapiens
  misc_feature: HEFZJCU01EPI3F.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgtaggacacggctgtttattactgtacgaaagaggggggatacgagtggcagctccaagtacttac

SEQ ID NO: 530077 - DNA, 493 bp, Homo sapiens
  misc_feature: HEFZJCU01AHV11.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcgggtcatatcgtccagtggacattcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 530078 - DNA, 403 bp, Homo sapiens; identical to SEQ ID NO: 445456
  misc_feature: HEFZJCU01D48K3.3.72.G06.1.454.heavy.3.raw

SEQ ID NO: 530079 - DNA, 510 bp, Homo sapiens
  misc_feature: HEFZJCU01DS6GU.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagcgggagtccaagtactccttt

SEQ ID NO: 530080 - DNA, 500 bp, Homo sapiens
  misc_feature: HEFZJCU01CKRG1.13.9.A09.1.454.heavy.3.raw
tcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctagtaaaaggcagattcaccatctcaagagatgagtccagaagcatcgcctttctgcagatgagtagcctgaagaccgaggacacagccatctattactgtgctaagagagtattgcagtcctacga

SEQ ID NO: 530081 - DNA, 531 bp, Homo sapiens
  misc_feature: HEFZJCU01BSHBP.13.37.D04.1.454.heavy.3.raw
tcacgtactacacgaccggtgctcgatttagtagcatactgttgggtttgggggagctctgagagaggagcccagccctgggatttttcaggtgtttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaaccatctccagagacaattccaagaacacgctatatctgcagatgaacagcctgggagccggagggaccacgggtccgttttaatcctatcgtgcggaaaacggattaatttgtaaatgtaagtggtagctgta

SEQ ID NO: 530082 - DNA, 525 bp, Homo sapiens
  misc_feature: HEFZJCU01B59KL.21.76.G10.1.454.heavy.3.raw
tcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccgccaggctccagggaaggggctggagtgggtctcagttatttatagtggtggtggtgcagattacgcagactccgtgaagggccgattcaccatctccagagacaattccatgaacacgctgtatcttcaaatgaacagcctgagacgccgacgacacggcccgtctattactgtgcgacgggagtggacggggaggagggcagtggaatacgtttgacctacggtgggggtacg

SEQ ID NO: 530083 - DNA, 523 bp, Homo sapiens
  misc_feature: HEFZJCU01BA9EX.12.86.H09.1.454.heavy.3.raw
  modified_base (496)..(496): a, c, t, g, unknown or other
  modified_base (505)..(505): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatggggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctgggtgaccgtctcctcagcctcaccaaggcccatcggtcttcccctggcgcctgctcagagcncctccgagngcacagcggccgtggccg

SEQ ID NO: 530084 - DNA, 504 bp, Homo sapiens
  misc_feature: HEFZJCU01CRIJQ.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacaatggaccctgtggacacagccacatattactgtgcacagagatacgggcagcacggttgggtttgggggctacgtcggggccagggaaccctggtcaccgtctcctcagcctccacccg

SEQ ID NO: 530085 - DNA, 543 bp, Homo sapiens
  misc_feature: HEFZJCU01EOGNR.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctgggtgtgggtctcacatattaatctcgatgggagtaatttagcctacgcggactccgtcaagggccgattcaccgtctccagagacaacaccaagaaacacactatatctgcagattgacagtctgagacccgaggacacggctgtgttattactgtgcaaggcagttcgtggaaacgagttagtggttggggggtaggttggggttttttttcgttacgttaacgggtagtac

SEQ ID NO: 530086 - DNA, 521 bp, Homo sapiens
  misc_feature: HEFZJCU01EOPUL.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttaggaatgaacagctaagtcctgaggacacgggtgtatactactgtacgaagggaaggggggaaccgaggcgggagttccaagtactcctttgacgt

SEQ ID NO: 530087 - DNA, 508 bp, Homo sapiens
  misc_feature: HEFZJCU01D65EP.8.38.D05.1.454.heavy.3.raw
  modified_base (293)..(293): a, c, t, g, unknown or other
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccnccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagtgaggacacggctgtttattactgtacgaaagaggggggatacgagtggcagctccaagtacttacg

SEQ ID NO: 530088 - DNA, 518 bp, Homo sapiens
  misc_feature: HEFZJCU01D5M82.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaagccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactactggggccagggaactcgtggtcaccgtctccgcagcctccaccaagggcccatcc

SEQ ID NO: 530089 - DNA, 516 bp, Homo sapiens
  misc_feature: HEFZJCU01EZQIS.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcggaggccctactcctacagtgaccacctccacgctcgggttcgacctctcgggggtccaacc

SEQ ID NO: 530090 - DNA, 511 bp, Homo sapiens
  misc_feature: HEFZJCU01ER4G9.4.81.H04.1.454.heavy.3.raw
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagacctgagagtcgaggactcggctgtctactacgtgtgcgaaggaataaggggagcctaccctacgatttggacac

SEQ ID NO: 530091 - DNA, 518 bp, Homo sapiens
  misc_feature: HEFZJCU01BVIPW.49.81.H04.1.454.heavy.3.raw
  modified_base (486)..(486): a, c, t, g, unknown or other
agtcgagagacacgaccggtgctcgatttagtagtgtagattcgcggggggctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggcttattttattactgtgcgaacttaancacggaggacaaggggtacacccccggtcacg

SEQ ID NO: 530092 - DNA, 525 bp, Homo sapiens
  misc_feature: HEFZJCU01CJ3YS.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcagggatcatccctatgtttggagtcgcaaactacgcacagaagttccggggcaaagtcacgttgaccgcggacacagtcacggacacagcctacatggaactcaacggcctcagatttgaggacacggccgtctacttattgtgcgagagtgagaaattacgtggctactccttcgactactggggccagggaacccctgggtccacc

SEQ ID NO: 530093 - DNA, 503 bp, Homo sapiens
  misc_feature: HEFZJCU01A7E17.48.33.C11.1.454.heavy.3.raw
agtatacatacacgaccggtgctcgatttagagtgagctcgttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacg

SEQ ID NO: 530094 - DNA, 540 bp, Homo sapiens
  misc_feature: HEFZJCU01BDKIK.48.4.A04.1.454.heavy.3.raw
  modified_base (414)..(414): a, c, t, g, unknown or other
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcaatggtggatacaccaactacaacccgtccctcaagagccgagtcaccatcttagtggacacggcgaagaaccagttctccctgaaactgaccgctgtgaccgccgcggacacggcngtgtattactgtgcgagacgaagtgggcggggtggctacggacttgacttttgggggccaggggaaacctcggtcaacccggtctccccagcttcccaccaaagggcccatcggtcctttcccccg

SEQ ID NO: 530095 - DNA, 489 bp, Homo sapiens
  misc_feature: HEFZJCU01DOZNC.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacgggattgggcgcctggggccaagggaccacggtcatcgtctccgcagcctccaccaagggcccatcgtcttcccctggcaccctcctccaagagcacctctgggggcacagcggccctgggctgcctggtcaaggacacttcgagtgcgtct

SEQ ID NO: 530096 - DNA, 540 bp, Homo sapiens
  misc_feature: HEFZJCU01D07OV.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgacccctgggggtcccgggggaacccgtggtcaccgtcctcccctacccctccaacccg

SEQ ID NO: 530097 - DNA, 506 bp, Homo sapiens; identical to SEQ ID NO: 446520
  misc_feature: HEFZJCU01C6CYZ.10.38.D05.1.454.heavy.3.raw

SEQ ID NO: 530098 - DNA, 481 bp, Homo sapiens
  misc_feature: HEFZJCU01DG65A.52.8.A08.1.454.heavy.3.raw
cgcagtacgacacgaccggtgctcgatttagcatactctacagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagactgaagacacggctgtatattactgtgacgaacttaa

SEQ ID NO: 530099 - DNA, 514 bp, Homo sapiens
  misc_feature: HEFZJCU01D1L40.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctagacatctgacgacacggccgtctattactgtgcgagacgtcccacgagtccggtgacgccgtacggcaggccggtcctttggaccttcgtc

SEQ ID NO: 530100 - DNA, 536 bp, Homo sapiens
  misc_feature: HEFZJCU01CYYX6.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttagttggggccagggagccctggtctaccg

SEQ ID NO: 530101 - DNA, 516 bp, Homo sapiens
  misc_feature: HEFZJCU01C646Z.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaagggccggagtgggtgtcagtcattagtagtagtggtgatagaatttaccacacagactccgtgaagggccgcttcaccatctctagagacaattcccagaacacaactgtatctgcaaatgactaggctgagagccgacgacacggccatttattactgcgcgaaggatatacgggtcgacaacggtggctacggtcgtttctagt

SEQ ID NO: 530102 - DNA, 528 bp, Homo sapiens
  misc_feature: HEFZJCU01ELNEW.10.85.H08.1.454.heavy.3.raw
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctagtggttcggaccctgttcgggggccacggggaaccctgggtaccg

SEQ ID NO: 530103 - DNA, 386 bp, Homo sapiens; identical to SEQ ID NO: 446054
  misc_feature: HEFZJCU01BPBK4.18.60.F05.1.454.heavy.3.raw

SEQ ID NO: 530104 - DNA, 498 bp, Homo sapiens; identical to SEQ ID NO: 448023
  misc_feature: HEFZJCU01EYQGM.11.71.G05.1.454.heavy.3.raw

SEQ ID NO: 530105 - DNA, 509 bp, Homo sapiens
  misc_feature: HEFZJCU01BH491.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctgggccaagggaccacggtcatcgtctccgcagcctccaccaagggcccatcggtcttcccctggcaccctcctccaagagcacctctgggggcacagcgccctgggctgcctggtcaggactacttccgagtgcgtct

SEQ ID NO: 530106 - DNA, 547 bp, Homo sapiens
  misc_feature: HEFZJCU01CCWEC.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctcgtccctgaggctgagctctgtgacagccgcgggacacggggctttattacctgtgcggtagagggacgggactacgggtgactactgggggtttccgaccccgttgggggccgacggggaaccctgggtccaccggtctccctcacgcctccaaccc

SEQ ID NO: 530107 - DNA, 382 bp, Homo sapiens
  misc_feature: HEFZJCU01CZAWX.11.61.F06.1.454.heavy.3.raw
cgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggctacttccgtatctctcg

SEQ ID NO: 530108 - DNA, 480 bp, Homo sapiens; identical to SEQ ID NO: 446171
  misc_feature: HEFZJCU01B01FU.22.36.D03.1.454.heavy.3.raw

SEQ ID NO: 530109 - DNA, 532 bp, Homo sapiens
  misc_feature: HEFZJCU01EXIGT.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacattactacacagactccgtgaaggggccgaattcaccatctcagaagacaattccaggaacacattgtatcttcaaatgaataacctgagagccgaggaccacggccatgtattactgtgtggggctatttacttgacccctggggccggggaaccctgggtcaccgtctccccaccctccacccg

SEQ ID NO: 530110 - DNA, 528 bp, Homo sapiens
  misc_feature: HEFZJCU01AR795.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccaataaacacagcctacatggagttgaggagcctgacatctgacgacacggccgtctattactgtgcgagacgtcccacgacgtccggtgacgccgtacggccaggccggtccttttacgactttcgtcgggggccaggggtaccg

SEQ ID NO: 530111 - DNA, 482 bp, Homo sapiens
  misc_feature: HEFZJCU01BQUW2.52.8.A08.1.454.heavy.3.raw
  modified_base (444)..(444): a, c, t, g, unknown or other
cgcagtacgacacgaccggtgctcgatttagcatactctacagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactggtccgccaggctccaggcaaggggctggagtgggtggcagttatatcatatgatgggaagcaagatatactatgtagactccgtgaagggccgattcatcatctccagagacaactccgagaacacgctagtatctgcaaatgaacaggctgaganctgaagacacggctgtatatttactgtgcgaacttaac

SEQ ID NO: 530112 - DNA, 521 bp, Homo sapiens
  misc_feature: HEFZJCU01DIGZ3.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggcagggaaccctggtgaccgtctcctcagcctccaccaagggcccatcggtcttcccctggccgcctgctccagagcacctccgagagcacagcggccctggg

SEQ ID NO: 530113 - DNA, 416 bp, Homo sapiens
  misc_feature: HEFZJCU01CKK9X.14.74.G08.1.454.heavy.3.raw
cgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacg

SEQ ID NO: 530114 - DNA, 531 bp, Homo sapiens
  misc_feature: HEFZJCU01CY7RF.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattggggagtatctattttagcgggagcacctaccagaacgcgtccctcaagagtcgaatcaccatgtcggtggacacatcgaagaaccagatctccttaagtgaggtctgtgaccgccgctgacacggccgtctattactgtgcgagagtccgtgctggaagaacacttttttgactattggggccagggaatcctggtcacgtcgccgtcagcctccaccaacgggcccatcggtcttccccg

SEQ ID NO: 530115 - DNA, 526 bp, Homo sapiens
  misc_feature: HEFZJCU01ANOKJ.48.5.A05.1.454.heavy.3.raw
  modified_base (442)..(442): a, c, t, g, unknown or other
agtatacatacacgaccggtgctcgatttagatagatagacagggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgcaaatgaacagcctgagngtcgacgacacggccgtatactactgtgcgtagacagatgctgccgcctgttccgtggggccacgggaaccctggtcaccgtcc

SEQ ID NO: 530116 - DNA, 520 bp, Homo sapiens
  misc_feature: HEFZJCU01D0AMT.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaagggctggagtgggtggccaacatagagtacgatggaagtgaagaaaactatgtggactccgtgaagggccgattcaccatctccagagacaacgacaagaatttagtgtatctgcaaatgagcagcctgagagccgaggacacggctgtgtattattgtgcgag

SEQ ID NO: 530117 - DNA, 501 bp, Homo sapiens
  misc_feature: HEFZJCU01EQJ2X.11.27.C05.1.454.heavy.3.raw
cgagagataccacgaccggtgctcgatttagacgcgatcgaagggtttggggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactatgcagactcactgaagggccgactcaccatctccagagacaacgcccaagaactcactgtatctgcaaatgaacagcctgagagccgaggacacggctgtgtattactgtgcgagaggagctattatctggaaccccg

SEQ ID NO: 530118 - DNA, 517 bp, Homo sapiens
  misc_feature: HEFZJCU01EAG3L.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgacgagcacagcggccctcggcgtcg

SEQ ID NO: 530119 - DNA, 396 bp, Homo sapiens
  misc_feature: HEFZJCU01D70RP.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagtagcacagcggccctgggctgcctggtcaaggactacttccgagtagtaca

SEQ ID NO: 530120 - DNA, 538 bp, Homo sapiens
  misc_feature: HEFZJCU01DYXC4.14.57.F02.1.454.heavy.3.raw
  modified_base (386)..(386): a, c, t, g, unknown or other
  modified_base (513)..(513): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcattttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagatacgaagtctatgatacccaatttgggaggggcctttcatgtctggggccaagggacgcgtggtcaccgtctcttcagcctccaccaagggcccatcggtcttcccctggcaccctccnccaagagcacctctggggcacagcc

SEQ ID NO: 530121 - DNA, 534 bp, Homo sapiens
  misc_feature: HEFZJCU01B1582.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaaggccgattcaccatctcagaagacaattccaggaacacattgtatcttcaaatgaataacctgtagagccgaggacacggccatgtaattactgtgtgggggcatttacttgaccccgtggggccggggaaccctggtcaccgtctccccaccctccaccaac

SEQ ID NO: 530122 - DNA, 374 bp, Homo sapiens
  misc_feature: HEFZJCU01D9DIN.49.24.C02.1.454.heavy.3.raw
agtcgagagacacgaccggtgctcgatttagtacagatcgttagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcgcctctcttgagtactggggccagggatccctggtcatcgtctcctcagcctccaccaagggcccatcggtcttccccctggcgccctgctccaggagcaccctccgagagcacagcggccctgggctgcctggtcaaggactacttcctctctcgact

SEQ ID NO: 530123 - DNA, 491 bp, Homo sapiens
  misc_feature: HEFZJCU01ADEBH.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagccctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctagaggacacggccttgtattactgtgcaaggaggtat

SEQ ID NO: 530124 - DNA, 510 bp, Homo sapiens
  misc_feature: HEFZJCU01ERLMB.10.38.D05.1.454.heavy.3.raw
  modified_base (481)..(481): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatcccagcctggggggtccctgagactctcctgtgcagcctctgggttcagcatcagtaacgactacatgacctgggcccgccaggctccagggaaggggctggagtgggtctcagttattgaaacagatggcactacatattattctgacttccgtgaacgggccggttcacccctctccagagacacttccaacaacatcttgtatcttcacatgcacaatctgagagtcacgacacggccacctattattgtgccgcgacatnaactacgctcaattctggggccagggacg

SEQ ID NO: 530125 - DNA, 522 bp, Homo sapiens
  misc_feature: HEFZJCU01EFDZI.52.78.H01.1.454.heavy.3.raw
  modified_base (441)..(441): a, c, t, g, unknown or other
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcacacttccagagacaacatcaagaactcaatgtatctaccaaatgaancagtctgacatccgaaggacacggccgttagtatttactgttgcgagagtttctttggggattggttgtcgtttggccacc

SEQ ID NO: 530126 - DNA, 538 bp, Homo sapiens
  misc_feature: HEFZJCU01DMVJX.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattccaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccacgccctccaccaagggccccatccggtcgtttccccctcggtccgccctcg

SEQ ID NO: 530127 - DNA, 542 bp, Homo sapiens
  misc_feature: HEFZJCU01AL9QY.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaaccatctccagagacaattacaagaacaccctttatctgcaaatagacagcctgagaccagacgacacggactgtctattattgcgcgagagagacacacgaacctactggccaatactatgggggcttgttctggggccaggggaccctggtccatcgtcctccccacgccctcccaccaacgggccccagtccggtccttccccctcggccgcccctc

SEQ ID NO: 530128 - DNA, 494 bp, Homo sapiens
  misc_feature: HEFZJCU01EKR2N.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatggggtggcagatatacaatatgatgacagtaaaatatactatggagactccttcaagggccgattcaccatctccagagacaattccaagaacatggtgtatctgcaaatcgaccagcctgagagccgaggacgacgggtgtttattacgttgtgggagaaatccta

SEQ ID NO: 530129 - DNA, 512 bp, Homo sapiens
  misc_feature: HEFZJCU01B8HD7.49.81.H04.1.454.heavy.3.raw
  modified_base (446)..(446): a, c, t, g, unknown or other
  modified_base (496)..(496): a, c, t, g, unknown or other
agtcgagagacacgaccggtgctcgatttagtagtgtagattcgcgggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaaacagcctganagctgaggacacggctatttattactgtgcgtaacttaatcacggagganaagggtcgacccccgt

SEQ ID NO: 530130 - DNA, 540 bp, Homo sapiens
  misc_feature: HEFZJCU01DIXAO.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagaacacggccgtgtattactgtgcgagatgtaggaaaaagttatggcttgtgttttatggggccagggagccctggtcctaccg

SEQ ID NO: 530131 - DNA, 509 bp, Homo sapiens
  misc_feature: HEFZJCU01ETFET.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccggattcaccatctccagagacgattccaagaacacgttgtatcttcaaatgaacagcctgacagtcgacgacacggccatgtatttttgtgcgagcgacccggggctcctcaatggctttcattacg

SEQ ID NO: 530132 - DNA, 505 bp, Homo sapiens
  misc_feature: HEFZJCU01CGMVW.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccggacgacacggccatatattactgtgcgaaagcaccggcagttagtccacccatacctactttgactac

SEQ ID NO: 530133 - DNA, 533 bp, Homo sapiens
  misc_feature: HEFZJCU01B7SI5.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccggtgtattactgtgcgagatgtggaaaataatggctgttgtttattggggccaggggagccctggtcaccgt

SEQ ID NO: 530134 - DNA, 532 bp, Homo sapiens
  misc_feature: HEFZJCU01DF8BY.51.28.C06.1.454.heavy.3.raw
  modified_base (529)..(529): a, c, t, g, unknown or other
cgatcgtatacacgaccggtgctcgatttagagctcacgtattgggtttggggatggtggcagctcccagatgggtcctgtcccaggtgcagctgcaggagtcgggcccaggactggtgaagccttcggagaccctgaccctcacctgtactgtgtctgatgactccatcgggagttactactggacctggatccggaagcccccagggaagggactggagtggattggatatatctattataatgggaggaccgagtacaacccctccctcaagagtcgagtcaccatatcagttgactcctccaagaaccagttctccctgaggctgaactctgtgacctctgcggacacggccatgtatttctgtgcgaaagttcaggccccatcttattatgacgctagtggttatcaaataggggcctactttgactactggggccggggaacccagggtcaccgtctcctcagcctccaccaagggcccatcggtctcccctgcacctcctccaagagcacctctggggcacngcc

SEQ ID NO: 530135 - DNA, 562 bp, Homo sapiens
  misc_feature: HEFZJCU01ANB6G.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggacgtacggtgtactacgttgggggttcgacccccgtgggggacccaagggggtaaaccccgtgggtacctacccggttcctcccgttccaacgcccttacccaaaccc

SEQ ID NO: 530136 - DNA, 392 bp, Homo sapiens; identical to SEQ ID NO: 444626
  misc_feature: HEFZJCU01BYV5Z.49.46.E02.1.454.heavy.3.raw

SEQ ID NO: 530137 - DNA, 498 bp, Homo sapiens
  misc_feature: HEFZJCU01BDZYJ.48.59.F04.1.454.heavy.3.raw
agtatacatacacgaccggtgctcgatttagtacacacacttagggattggggatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccgaagggacaatggtcaccgttctcttc

SEQ ID NO: 530138 - DNA, 495 bp, Homo sapiens
  misc_feature: HEFZJCU01BO946.4.58.F03.1.454.heavy.3.raw
  modified_base (461)..(461): a, c, t, g, unknown or other
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctaccatggagctgagcagcctgacatctgaagacacggactgtgtattactgttcgagacggntagtctggggatctagttatagtgatcgtcgttc

SEQ ID NO: 530139 - DNA, 512 bp, Homo sapiens
  misc_feature: HEFZJCU01CU5K2.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacgagtgtcttcacccatcctccgggacagacttaccatgaccacgaactcctccataaacacagcctaccatggagttgaggagcctgacatctgacgacacggccgtctattactgtgcgagagtcccacgatccggtgagcctacggcagcggtcctttgacttcgtggggccagggacg

SEQ ID NO: 530140 - DNA, 509 bp, Homo sapiens
  misc_feature: HEFZJCU01ASBCI.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtggtattactgtgcgagagagtggggcccacgacgttactacgctatggacgtcgt

SEQ ID NO: 530141 - DNA, 515 bp, Homo sapiens
  misc_feature: HEFZJCU01EU3SI.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccagggcccatcggtcttcccctggcaccctcctccaagagcacctctgggggcacagcggccctgggctgcctggtcaaggactactccagacgtatca

SEQ ID NO: 530142 - DNA, 517 bp, Homo sapiens
  misc_feature: HEFZJCU01CL3EU.48.81.H04.1.454.heavy.3.raw
agtatacatacacgaccggtgctcgatttagtagtgtagattcgcggggggcatcacatagcaaccacgttcctcccctaaagaagccccgggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggccccctggacacgggcttgagtggatgggatcgatcatccctttctctaatgtcacaagatacacacagagattccagggcagaatcacacttaccgcggacaaatccacgggcacagcgcagttggacctgagcggtcctggagaccgtgaggacaacggccattactctgtgcgcggggaggtggacggagctcggtttccggagttatcactctactactttgaattc

SEQ ID NO: 530143 - DNA, 522 bp, Homo sapiens
  misc_feature: HEFZJCU01C154Q.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctcgtctattattgcgcgagagagacacacgaacctactggccaatactatgggggcttgttctggggccaggggacctggtcatcgtctccccagccctccaccaagggcccatcggtcttcccctggcg

SEQ ID NO: 530144 - DNA, 524 bp, Homo sapiens
  misc_feature: HEFZJCU01C7K3R.46.67.G01.1.454.heavy.3.raw
  modified_base (433)..(433): a, c, t, g, unknown or other
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctccactacagtgcggcctccagagtcgagccctcatatccatagacacgtccaagaaccagtttccctgacgctgacgtctgtgaccgccgcagacacgctgtctattattntgcgagactagccttctgtagtgggggtacttcgcaacccggggataccgtaactcccacctcggtcttcgggacatcgtcggggccggac

SEQ ID NO: 530145 - DNA, 516 bp, Homo sapiens
  misc_feature: HEFZJCU01BIQNQ.3.17.B06.1.454.heavy.3.raw
  modified_base (257)..(257): a, c, t, g, unknown or other
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctntggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgacgaaccgacgacacggccgtctattagttgttgtcatacgacctaaggactacaacggtaac

SEQ ID NO: 530146 - DNA, 493 bp, Homo sapiens
  misc_feature: HEFZJCU01CRP1R.11.38.D05.1.454.heavy.3.raw
cgagagataccacgaccggtgctcgatttagtatctgatagttgggtttgggggaggcttggtacagcctgggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccaggggaaccctggtcaccgtctcctcagcctccaccaagggcccatcggtcttcccctggcaccctcctccaagagcacctctggggacacagcggccctgggctgcctggtcaaggactacttccgtatctctcc

SEQ ID NO: 530147 - DNA, 503 bp, Homo sapiens
  misc_feature: HEFZJCU01A26J3.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtctacccatactactttgactac

SEQ ID NO: 530148 - DNA, 525 bp, Homo sapiens
  misc_feature: HEFZJCU01BHY0F.9.63.F08.1.454.heavy.3.raw
  modified_base (455)..(455): a, c, t, g, unknown or other
  modified_base (474)..(474): a, c, t, g, unknown or other
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccgggacagatgattttttggatgtctggggccaaggtacagcggtcaccgtcgcctcngcctccaccaagggcccancggtcttccccctggcaccctcctccaagagcacctctcgggggcacacgg

SEQ ID NO: 530149 - DNA, 472 bp, Homo sapiens
  misc_feature: HEFZJCU01ED50W.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtccaccatgaccagggacacgtccatcagcacagcctacatggaattggagcaggctgacatctgacgacacggccgtgtatttattgtgcgagag

SEQ ID NO: 530150 - DNA, 536 bp, Homo sapiens
  misc_feature: HEFZJCU01AP0D4.17.28.C06.1.454.heavy.3.raw
  modified_base (524)..(524): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacggtggactctgtgaagggccgtttcaccatctccagagacaacgccaagaattcactgtatctacaactgaacagcctgagagtcgcagacacggccgtgtattactgtgcgagatgtaggaaaagtatggctgtgtttattggggccaggggancctggtctaccg

SEQ ID NO: 530151 - DNA, 536 bp, Homo sapiens
  misc_feature: HEFZJCU01DHIWF.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaatagactacggtgcacccgtgaaaggaagattcaccatctcaagagataattcaaaacgacggtgtatttgcaaatgaacagcctgaaaccgaggacacagccgtctattactgtaccacagattcggaagtgcatcgagtaaaggagctatgcttttgatatctggggcccagggac

SEQ ID NO: 530152 - DNA, 526 bp, Homo sapiens
  misc_feature: HEFZJCU01ANMX7.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgagctgagctctgtgacagccgcggacacgggcgtttattactgtgcgagaggggacggactacggtgactactgggggttcaccccgtggggccaagggaaccctggtcaccgtctctcagcctccaccg

SEQ ID NO: 530153 - DNA, 509 bp, Homo sapiens
  misc_feature: HEFZJCU01EZ3FH.4.67.G01.1.454.heavy.3.raw
agcactgtagcacgaccggtgctcgatttagagtatacatattgggtttggggtctgagagaggagcccagccctgggattttcaggtgttttcatttgatgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcacgtggcgattatacatattatacagactccgtgaagggccgcttcaccatctccagagacaattccaagaacacggtgtatctgcaaatgaacagcctgagagccgaggacacggccacatattactgtgacgaaagatcgtcgggctggttccgcggttacc

SEQ ID NO: 530154 - DNA, 530 bp, Homo sapiens
  misc_feature: HEFZJCU01CHOJE.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaatgggcgggtggctacgacttgacttttggggccagggaaacctggtcaccgtcctccccagccttccaccaacggggcccatcggtctttcccccg

SEQ ID NO: 530155 - DNA, 511 bp, Homo sapiens
  misc_feature: HEFZJCU01C1QCN.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattaactgtgcgaaagcacggcagttagtcacccatactactttcgactactggggtccg

SEQ ID NO: 530156 - DNA, 510 bp, Homo sapiens
  misc_feature: HEFZJCU01ERV6Y.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgacatgactacgggaaagcttttgatctctggggccaagggacactggtcaccgtctcttcagcctccaccaagggcccatcggtcttcccctggccgcccgtgctccaggacg

SEQ ID NO: 530157 - DNA, 515 bp, Homo sapiens
  misc_feature: HEFZJCU01BQ3OQ.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgactgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacgactattactgtgacgtaaagatcctcggggctggttccgcggtcccggggt

SEQ ID NO: 530158 - DNA, 514 bp, Homo sapiens
  misc_feature: HEFZJCU01D9OV1.49.59.F04.1.454.heavy.3.raw
  modified_base (463)..(463): a, c, t, g, unknown or other
agtcgagagacacgaccggtgctcgatttagtacacacacttagggattggggatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccagggacagaatcacgataaccgcggacacatccacgaggcactattttcatggaactgagcagcctcagatccgaggacacggccgtttacactgtgcgagngactcccggattcccgcgtttcgaggatgactactggggccaggggaccct

SEQ ID NO: 530159 - DNA, 517 bp, Homo sapiens
  misc_feature: HEFZJCU01ERCL7.48.34.D01.1.454.heavy.3.raw
agtatacatacacgaccggtgctcgatttagatcgtctgtgttgggtttgggggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcgggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgacgcgccctgagaccgtcgacgacacggcgtgtactactttactgtgcgaggagggcgtccgagtttaacacgccgtcggga

SEQ ID NO: 530160 - DNA, 492 bp, Homo sapiens
  misc_feature: HEFZJCU01EVDIK.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcgaaggacgtactcccacgagagta

SEQ ID NO: 530161 - DNA, 381 bp, Homo sapiens
  misc_feature: HEFZJCU01DFJKT.11.61.F06.1.454.heavy.3.raw
cgagagataccacgaccggtgctcgatttagctacgctctaagggaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 530162 - DNA, 522 bp, Homo sapiens
  misc_feature: HEFZJCU01A85JX.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttggatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggacccacggaacgttactacgcgtatgggacgtcgtgggggacc

SEQ ID NO: 530163 - DNA, 519 bp, Homo sapiens
  misc_feature: HEFZJCU01DPPB3.10.79.H02.1.454.heavy.3.raw
  modified_base (436)..(436): a, c, t, g, unknown or other
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccaggggaaggggctggagtgggtttcatacattttatcctagtggtgataccatatactacgcagactctgtgaagggccgattcaccatctccagggacaacgccaagaactnactgactttgcaatgaacaccctgcgagccgaggacacggccgtatattactgtgcgagaataacccgttcgcctggttattt

SEQ ID NO: 530164 - DNA, 530 bp, Homo sapiens
  misc_feature: HEFZJCU01C1PJA.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccggtgaggggccgattcaccatctccagagacaattacaagaacacctttatctgcaaatagacagcctgagaccagacgacacggctgtctattattgcgcgagagagacacacgaacctactggccaatactatgggggcttgttctgggggtccaggggaccctggtcatcgtctccccagcctccaccaacggggcccactcggtccttccccctggtccg

SEQ ID NO: 530165 - DNA, 533 bp, Homo sapiens
  misc_feature: HEFZJCU01BLS1I.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattccaccgtctccagagacaacaccaagaacacactatatctgcagattgacagtctgacgacccgaggacacggctgtgtattactgtgcaaggcagttcgtggaaacagttatgggttggggggtagtttgggttttttttcgtacgttacgggat

SEQ ID NO: 530166 - DNA, 538 bp, Homo sapiens
  misc_feature: HEFZJCU01CAVRC.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaaattccaggaacactattgtatcttcaaatgaataacctgagagccggaggacacggccatgtattactgtgtggggcattttcttgaccccgtgggggccggggtaaccctggtccaccgtcctccccaccctccaaccg

SEQ ID NO: 530167 - DNA, 535 bp, Homo sapiens
  misc_feature: HEFZJCU01CP76Y.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtgggggtgaggatgggacattctgccattgtgattactactactactactacatggacgtctggggcaaagggaccacggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 530168 - DNA, 497 bp, Homo sapiens
  misc_feature: HEFZJCU01BRBNE.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatcccacgagcacagcctacatggagctgaggagcctggagatctagacgacacggccgtgtacttactgtgcgagagaagggtttactatggttcgggagtctccgaccca

SEQ ID NO: 530169 - DNA, 513 bp, Homo sapiens
  misc_feature: HEFZJCU01DNB2L.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacgggccgtgtattactgtgtgagagacatgacaacggtgataaccggaggggtt

SEQ ID NO: 530170 - DNA, 481 bp, Homo sapiens
  misc_feature: HEFZJCU01EEF0L.19.71.G05.1.454.heavy.3.raw
  modified_base (397)..(397): a, c, t, g, unknown or other
  modified_base (432)..(432): a, c, t, g, unknown or other
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaagacatatttcatgtccaacacgtggaatacaaattatgcaccatcctgttgagagtcgactgacaatcaactagacanatcgaagaaccagttcctcctgcagctgacctctntgactcccgaggacacggtgtatattactgtggaagagcccccgatacg

SEQ ID NO: 530171 - DNA, 429 bp, Homo sapiens; identical to SEQ ID NO: 447944
  misc_feature: HEFZJCU01D558X.4.37.D04.1.454.heavy.3.raw

SEQ ID NO: 530172 - DNA, 502 bp, Homo sapiens
  misc_feature: HEFZJCU01DK5XW.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcactagaactttcaggacagggtcaccatgaccacggacacgtccatcaacacagcctacatggaactgaggagcctaagatctgacgacacggccgtttattattgtgcaataagaattgacaacgatgtcttttgatatggtgggaccg

SEQ ID NO: 530173 - DNA, 522 bp, Homo sapiens
  misc_feature: HEFZJCU01DKIHW.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtgacacagccacatattactgttcacgctctatggttcggggagttatagtccctactttgactactggggccaggggaactcgtggtccaccgtctccggcaggcctccaccaaggggccccatcc

SEQ ID NO: 530174 - DNA, 491 bp, Homo sapiens
  misc_feature: HEFZJCU01DDNGP.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctggctgcctggtcaaggactacttccgagtgcgtct

SEQ ID NO: 530175 - DNA, 489 bp, Homo sapiens; identical to SEQ ID NO: 444791
  misc_feature: HEFZJCU01BOQIZ.47.85.H08.1.454.heavy.3.raw

SEQ ID NO: 530176 - DNA, 527 bp, Homo sapiens
  misc_feature: HEFZJCU01DRL1L.40.81.H04.1.454.heavy.3.raw
tctagcgactcacgaccggtgctcgatttagtagtgtagattcgcgggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatcgtgagcggacgtgacctctgacgacacggccactgttattacctgtaggaaaggaaggtaccggttgggttggaccttacccggccgggggtccgtaggacccctacgtacc

SEQ ID NO: 530177 - DNA, 496 bp, Homo sapiens
  misc_feature: HEFZJCU01DGXG8.12.75.G09.1.454.heavy.3.raw
  modified_base (403)..(403): a, c, t, g, unknown or other
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctanatagagctgcgcagcctgagatctgaagacacggccatttattactggtgcgagagatgacgacggggccctccccgacaacttcgggtttta

SEQ ID NO: 530178 - DNA, 516 bp, Homo sapiens
  misc_feature: HEFZJCU01A4SAE.53.28.C06.1.454.heavy.3.raw
  modified_base (208)..(208): a, c, t, g, unknown or other
cgcgtatacacacgaccggtgctcgatttagagctcacgtattgggtttggggctgggagaggagcccagcactgggattccgaggtgtttccattcggtgatcagcactgaacacagaggactcaccatggagtttttggctgagctgggttttccttgttgctattttaaaaggtgtccagtgtgaggtgcagctggtaaaaaggngtctggaggaggcttggtccagcctggggggtccctgagactctcctgtgcagcctctggattgaccgtcagtagcaactacatgagctgggtccgccaggcccccagggaaggggctggagtgggtctcaacaatttatagcggtggtaggacataccacgcagaccccgtgaagggccgattcaccatctccagacacaattccaagaacacactgtttcttcaaatggacttccttgagaactgaggacacggccgtgtattactgcgcgagagtgcatgatagtggtttccatgatgtcttttg

SEQ ID NO: 530179 - DNA, 517 bp, Homo sapiens; identical to SEQ ID NO: 446891
  misc_feature: HEFZJCU01C5ZM2.17.33.C11.1.454.heavy.3.raw

SEQ ID NO: 530180 - DNA, 544 bp, Homo sapiens
  misc_feature: HEFZJCU01A4TAD.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattaccaagaacacggtgaatcttcaaatgaacagcctgagaaccgaggacacggccgtatattattgtataggttatggtggtaattcgggcccctggggccgaggaaccgtggtcaccgtctcctcagcctccaccg

SEQ ID NO: 530181 - DNA, 510 bp, Homo sapiens
  misc_feature: HEFZJCU01C6M3B.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccacctccacgctggttccgacctcgtcggggccac

SEQ ID NO: 530182 - DNA, 490 bp, Homo sapiens
  misc_feature: HEFZJCU01BI6VG.49.59.F04.1.454.heavy.3.raw
agtcgagagacacgaccggtgctcgatttagtacacacacttagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttacaatgaacagtctgagacgtgaagacacggctgtctattactgtgcgactgagatgtctt

SEQ ID NO: 530183 - DNA, 494 bp, Homo sapiens
  misc_feature: HEFZJCU01CWQ3H.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgcctgctcagagcgactccgagagcacagcggcctcgggctcgcctggtcgtagacgta

SEQ ID NO: 530184 - DNA, 514 bp, Homo sapiens
  misc_feature: HEFZJCU01B453H.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgattctctggggccgtggcacctggtcactgtctcctcggcttccaccaagggcccatcggtcctcccctggcgcctcgctcacggagcacctctggggcgacacgcggcccg

SEQ ID NO: 530185 - DNA, 508 bp, Homo sapiens
  misc_feature: HEFZJCU01AU28Y.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggagtccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagttcgacgacacggccacctattattgtgcgcgacatgactacgctcaattctggggccagggacg

SEQ ID NO: 530186 - DNA, 493 bp, Homo sapiens
  misc_feature: HEFZJCU01A5AYN.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctcgaccagcctgagaactgacgacacgtctctctactactgtgcgagagagttcgacgagt

SEQ ID NO: 530187 - DNA, 524 bp, Homo sapiens
  misc_feature: HEFZJCU01D3RU6.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctcctaccaacgggcccatcggtctttccccctggccgcctgcctccaggagcacctccgagagacacacgcggcccgtcggcgtcg

SEQ ID NO: 530188 - DNA, 531 bp, Homo sapiens
  misc_feature: HEFZJCU01BL2DN.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctccttttacacctcccttcgacttctggggccagtacggacccggtaccg

SEQ ID NO: 530189 - DNA, 520 bp, Homo sapiens
  misc_feature: HEFZJCU01CLY5X.48.86.H09.1.454.heavy.3.raw
agtatacatacacgaccggtgctcgatttagtgctatagacttgggtttgggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacaggtgggagcacctactacaacccgtccctcaaaagtcgaggcaccatatccgtagacacgtccaagaaccaattctccctgaagctgagctctgtgaccgccgcagacacggctgtctatttactgtgcgacggccccgagcgcagtggtcttttgatgtcctttgtatatgtcggggcgaaggacaatggtcgaccgtcgtcttcagcctaccaccgaacggccg

SEQ ID NO: 530190 - DNA, 513 bp, Homo sapiens
  misc_feature: HEFZJCU01BUEFK.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacaggacttaccatgaccacgaactcctccataaacacagcctacatggagttgaggagcctgacatctgacgacacggccgtctattactgtgcgagagtcccacgatccggtgagcctacggcaggcggcctttgactttctcggggccaggggacg

SEQ ID NO: 530191 - DNA, 429 bp, Homo sapiens; identical to SEQ ID NO: 447944
  misc_feature: HEFZJCU01CA1U9.4.37.D04.1.454.heavy.3.raw

SEQ ID NO: 530192 - DNA, 521 bp, Homo sapiens
  misc_feature: HEFZJCU01CVZ9Y.12.25.C03.1.454.heavy.3.raw
  modified_base (491)..(491): a, c, t, g, unknown or other
  modified_base (507)..(507): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggtagcctgcgatctgacgacgcggccgtatacttactgtggcgagagtacgtagcggctccgtcctttgacttacnggggcctgggaacctntcggtcaccggtct

SEQ ID NO: 530193 - DNA, 526 bp, Homo sapiens
  misc_feature: HEFZJCU01A9ISE.51.26.C04.1.454.heavy.3.raw
cgatcgtatacacgaccggtgctcgatttagtctagcgactttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccagcaaggggctggagtgggtggctgttataacttctgatggaggtacaacatattactcagacgccgtgaggggccgattcaccatctccagagacaagttccgggaacacactgtctctgcaatgaacagcctgagagctgaggacgaggcttagtttattactgtgtgcgtactccgacctacacgtagggtacgggtacgttcttcctccgacgtacgtagtac

SEQ ID NO: 530194 - DNA, 501 bp, Homo sapiens
  misc_feature: HEFZJCU01ECE0I.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacatttgataggctctatggactggacttctc

SEQ ID NO: 530195 - DNA, 492 bp, Homo sapiens; identical to SEQ ID NO: 445919
  misc_feature: HEFZJCU01BK946.14.25.C03.1.454.heavy.3.raw

SEQ ID NO: 530196 - DNA, 526 bp, Homo sapiens
  misc_feature: HEFZJCU01C7B9F.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaatgggcgggtggctacgacttgacttttggggccagggaaaccgtggtcaccgtctccccagccttccaccaaggcccatcggtcttcccccg

SEQ ID NO: 530197 - DNA, 512 bp, Homo sapiens
  misc_feature: HEFZJCU01BUWHO.18.39.D06.1.454.heavy.3.raw
  modified_base (463)..(463): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaaggcccatcggtcttcccctggcgccctgctccaggagcacctcncgggggcacgagcggcccgtgggctgcctggtcaggactacttcccact

SEQ ID NO: 530198 - DNA, 519 bp, Homo sapiens
  misc_feature: HEFZJCU01C0HTO.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagacgcacctctgggggcacacgcggccctggctgcctggtcaaggactacttccagacgtatca

SEQ ID NO: 530199 - DNA, 518 bp, Homo sapiens
  misc_feature: HEFZJCU01COQKC.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggccaccctcctccaagagcacctctgggggcacagcggccctgggctgcctgtcaaggactacttccagacgtatca

SEQ ID NO: 530200 - DNA, 493 bp, Homo sapiens
  misc_feature: HEFZJCU01ELVCR.48.23.C01.1.454.heavy.3.raw
  modified_base (456)..(456): a, c, t, g, unknown or other
agtatacatacacgaccggtgctcgatttagtacacgtgattagggattggggatgctttctgagagtcatggatctcatgtgcaagaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctgggagtggattgggagtatttaccacagtgggaggcacctactacaacccgtccctcaaaagtcgaggcaccatatccgtagacacgtccaagaaccaattctccctgaagctgagctctgtgaccgccgcagacacggctgtctattactgtgcgaggccccgagcgcngtggcttttgatgcttgatatgtgggcgaaggacaat

SEQ ID NO: 530201 - DNA, 501 bp, Homo sapiens
  misc_feature: HEFZJCU01B9OX9.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctggcaaggtcttgagtggatgggactaatcactcccaatggtgatgggactgcctacgcacagaagtttcagggcagacgtcaccatgaccagggacacgtccacgagaacaggactatttggagtttgagcagcctggagatctgacgacacggccgttttattactgtgcgcgagataatagtcacaactggaacggtcggttttggggt

SEQ ID NO: 530202 - DNA, 505 bp, Homo sapiens
  misc_feature: HEFZJCU01EO452.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactatctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcaagagtcacgattaccacggacacccccacgaacacagtctacatgcaactgacgagcctggagagctgacgacacggccgtctattactgtgcgagaatgttttctgtcatcgtacaatttgataggctctatggactggtacttcgtc

SEQ ID NO: 530203 - DNA, 524 bp, Homo sapiens
  misc_feature: HEFZJCU01C09B6.49.34.D01.1.454.heavy.3.raw
  modified_base (502)..(502): a, c, t, g, unknown or other
  modified_base (513)..(513): a, c, t, g, unknown or other
agtcgagagacacgaccggtgctcgatttagatcgtctgtgttgggtttggggacccgaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtaacagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccagggaacccgtnaccgtctcctntgcctccaccg

SEQ ID NO: 530204 - DNA, 508 bp, Homo sapiens
  misc_feature: HEFZJCU01C905U.4.57.F02.1.454.heavy.3.raw
  modified_base (493)..(493): a, c, t, g, unknown or other
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtgggccagggaaccctggtcaccgtctcctcagcttccaccaaggcccatcgtcttcccctgcgccctgctccagagcacctcnggggcacagcggccg

SEQ ID NO: 530205 - DNA, 518 bp, Homo sapiens
  misc_feature: HEFZJCU01B0385.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctggggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaacgggccggttcaccatctccagagacaattccaagaacacactgtatctgcaaatgaacagcctgagagccgacgacacggccatatattactgtgcgaaagcgaccggcagttagtacacccatactactttgaacctactggggacccg

SEQ ID NO: 530206 - DNA, 527 bp, Homo sapiens
  misc_feature: HEFZJCU01E0DEZ.53.10.A10.1.454.heavy.3.raw
  modified_base (514)..(514): a, c, t, g, unknown or other
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttgggggtttcgacccctggggccagggaaccctggtcaccgtctcctcagcctccaccaagggcccatcggtcttcccctggccacccgtccnccaagagcacctc

SEQ ID NO: 530207 - DNA, 527 bp, Homo sapiens
  misc_feature: HEFZJCU01EAQ89.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacgaacgttactacgctatggacgtctggggccaagggaccac

SEQ ID NO: 530208 - DNA, 520 bp, Homo sapiens
  misc_feature: HEFZJCU01B3VN5.40.9.A09.1.454.heavy.3.raw
tctagcgactcacgaccggtgctcgatttagcgagacgcgcaggggaggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaactatagcggactctgtgaagggccgattcaccatttccagagacaacgccaagaagtcactctctctacacatgaccagcctcgacagccgaggacacgggctgtttattactgtgcgagagatggcacgtcgggggcgtgtacttttgacctacgtggggcc

SEQ ID NO: 530209 - DNA, 476 bp, Homo sapiens; identical to SEQ ID NO: 445154
  misc_feature: HEFZJCU01D41LR.16.10.A10.1.454.heavy.3.raw

SEQ ID NO: 530210 - DNA, 546 bp, Homo sapiens
  misc_feature: HEFZJCU01EICCZ.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgagtctgttaccgccgcggacacggctgtctattactgtgcgaaggccctcacgatagaaactacgcccctggcgcttatcggacgtctggggccaagggaccacggtcaccgtcgtccctcacgcctcccaaccgacggcccgatcggtccttccccgtc

SEQ ID NO: 530211 - DNA, 530 bp, Homo sapiens
  misc_feature: HEFZJCU01AN23Y.9.78.H01.1.454.heavy.3.raw
  modified_base (489)..(489): a, c, t, g, unknown or other
  modified_base (514)..(514): a, c, t, g, unknown or other
tgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccaggggaagggctggagtgggtttcatacatttatcctagtggtgtataccatatactacgcagactctgtgaagggccgattcaccatctccagggacaacgccaagaactcactgactttgacaatgaacaccctgcgagccgaggacacggccgtatattacngttcgcggagaactaacccggttcnccttggttattacctt

SEQ ID NO: 530212 - DNA, 496 bp, Homo sapiens
  misc_feature: HEFZJCU01DRT6X.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaaccacgcagtatctgcaaatgaacagcctgagagctgaggacacggctgtgtattactgtgggagagatggaggtcgatattgt

SEQ ID NO: 530213 - DNA, 397 bp, Homo sapiens
  misc_feature: HEFZJCU01BC83R.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctggggctgcctggtcaaggactacttcctacgtgagct

SEQ ID NO: 530214 - DNA, 515 bp, Homo sapiens
  misc_feature: HEFZJCU01DL83Z.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggcca

SEQ ID NO: 530215 - DNA, 522 bp, Homo sapiens
  misc_feature: HEFZJCU01DLQEG.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagacgaggacacagccgtctattactgttgttaggggtaggttttacgtagtttttggtagtgggatatttaa

SEQ ID NO: 530216 - DNA, 494 bp, Homo sapiens
  misc_feature: HEFZJCU01DAQY6.11.81.H04.1.454.heavy.3.raw
  modified_base (455)..(455): a, c, t, g, unknown or other
  modified_base (482)..(482): a, c, t, g, unknown or other
cgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcctgtgcagcgtctggattcaccttcaggagctatgacatgcactgggtccgccaggctccaggcaaggggctggagtgggtggcagttatatggtatgatggaagttataaatactatggagactccgtgaagggccgattcaccatctccagagacacttccaagaacacggngtatctagcaaatgaacagcctgagancgaggcacggct

SEQ ID NO: 530217 - DNA, 525 bp, Homo sapiens
  misc_feature: HEFZJCU01DCKPR.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctgcgccctgctccaggagcacctccgagagcacagcggccctgggctgcctggtcaaggactacttcacg

SEQ ID NO: 530218 - DNA, 521 bp, Homo sapiens
  misc_feature: HEFZJCU01AOEF4.11.13.B02.1.454.heavy.3.raw
  modified_base (257)..(257): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtccttcccctggtcgccctgcctccaggtacgcacctccgagagcacagcggccctgggctcgg

SEQ ID NO: 530219 - DNA, 513 bp, Homo sapiens
  misc_feature: HEFZJCU01C825T.48.21.B10.1.454.heavy.3.raw
agtatacatacacgaccggtgctcgatttagtgtcgtcgcaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggccaccatatccgtagacacgtccaagaaccaattctccctgaagctgagctctgtgaccgcgcagacacggctgtctattactgtgcgaggccccgagccgcagtggtctttttgattgtcctttgtatattggtcgggaccgaaggacaataggtcaccgtctcttcg

SEQ ID NO: 530220 - DNA, 513 bp, Homo sapiens
  misc_feature: HEFZJCU01CPKTE.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctgggagtggggttggccatataaaaagtaagactgctggtgagacaacagactacgctgctgccttcagaggcagattcacccatcttcagagatgaatcacagagcactctgtttctgcaaatgaacagcctggaagacgcggacacagccatgtattattgtacattaggacactatagtccctggggccagggaaccctcg

SEQ ID NO: 530221 - DNA, 513 bp, Homo sapiens
  misc_feature: HEFZJCU01EGFK3.3.34.D01.1.454.heavy.3.raw
agacgcactccacgaccggtgctcgatttagatcgtctgtgttggggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattattgtgcgagagagagaacattaaatttggcgggctactacgagaacggattggggcgccgtggggccaagggaccacggtcatcgtctccgcagcctccaccaagggccatcggtcttcccctggcaccctcctccaagagcacctctgggggcacagcggcccgtgggctgcctggtcaaggactacttccagtgcgtct

SEQ ID NO: 530222 - DNA, 502 bp, Homo sapiens
  misc_feature: HEFZJCU01BYNHG.48.27.C05.1.454.heavy.3.raw
  modified_base (477)..(477): a, c, t, g, unknown or other
agtatacatacacgaccggtgctcgatttagacgcgatcgaagggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagccttccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacatgctgtttattactgtncgagagtgcggatttcacctacacg

SEQ ID NO: 530223 - DNA, 520 bp, Homo sapiens
  misc_feature: HEFZJCU01D3ZKA.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattgggagtggggtggcagtttgtttcatctggagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccaggcgggagttccaagtactccttgacgtctggggcc

SEQ ID NO: 530224 - DNA, 489 bp, Homo sapiens
  misc_feature: HEFZJCU01A8BF0.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggaccgtatattattgtgcccttgacttacta

SEQ ID NO: 530225 - DNA, 525 bp, Homo sapiens
  misc_feature: HEFZJCU01BLU09.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggaccctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgtcgaggagaggccgtttattttaggaccagctgttaaaaactcctactacggtctggacgtcgtggggccggacggtcgtac

SEQ ID NO: 530226 - DNA, 506 bp, Homo sapiens
  misc_feature: HEFZJCU01DEMXA.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaatgaacagtctgagagccgaggacacggccgtcttactttgtgcgactagaagtggggagctagtaggggtattt

SEQ ID NO: 530227 - DNA, 405 bp, Homo sapiens
  misc_feature: HEFZJCU01CVP2G.53.68.G02.1.454.heavy.3.raw
cgcgtatacacacgaccggtgctcgatttagtcgatagtgaagggaaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctggtctactactgtgcgaggggggggactagatttggtggctacgatcacccccatttttttgacttctggggccagggaaccctggtcaccgtctcctcagcctccaccaagggcccatcggtcttccccctggcaccctcctccaagagcacctctgggggcacagcgccctgggctgcctggtcaaggactacttcctcgtactgcg

SEQ ID NO: 530228 - DNA, 513 bp, Homo sapiens
  misc_feature: HEFZJCU01DAF2V.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccggctacgtgggggtcccgggagtccctggt

SEQ ID NO: 530229 - DNA, 531 bp, Homo sapiens
  misc_feature: HEFZJCU01DNOH9.51.35.D02.1.454.heavy.3.raw
  modified_base (522)..(522): a, c, t, g, unknown or other
cgatcgtatacacgaccggtgctcgatttagcacacgatagttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctgggccaagggaccacggtcaccgtctccttagcctccaccaagggcccatcggtcttccccctggccacctcctccaanagcacctcg

SEQ ID NO: 530230 - DNA, 516 bp, Homo sapiens
  misc_feature: HEFZJCU01BNARJ.10.85.H08.1.454.heavy.3.raw
catagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccgggctagtggttcggacctcgtcggggccac

SEQ ID NO: 530231 - DNA, 496 bp, Homo sapiens
  misc_feature: HEFZJCU01B4Y3Q.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttaataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgt

SEQ ID NO: 530232 - DNA, 503 bp, Homo sapiens
  misc_feature: HEFZJCU01BOPGT.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaaatgaacagcctgagagacgaggatacggctatttacgtattgtgtcgcgatcgacagaaaaagcggtggcctattc

SEQ ID NO: 530233 - DNA, 511 bp, Homo sapiens
  misc_feature: HEFZJCU01A9OLR.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagtcctacatggagttgagggagcctgacatctgacgatacggccgtctattactgtgcgagagtcccaacgatccggtgagcctacggcaggcggccctttgacctttcgtc

SEQ ID NO: 530234 - DNA, 483 bp, Homo sapiens
  misc_feature: HEFZJCU01DLN99.49.5.A05.1.454.heavy.3.raw
agtcgagagacacgaccggtgctcgatttagatagatagacaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaagggggctggagtggggtggcagttatatcatatgatggaagcaagatatactatgtagactccgtgaagggccgattcatcatctccagagacaactccgagaacacgctgtatctgcaatgaacaggctgagagctgaagacacggctgtatattactgtgacgaacttaatctac

SEQ ID NO: 530235 - DNA, 560 bp, Homo sapiens
  misc_feature: HEFZJCU01BN6ML.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttatactgtgcgagagggacggacgtacgggtgacctacgtcggggggtttccgaccccgtggggggcccaacgggggaacccgtcgggtccacccggttctcccttccacgcccctcccaaaccccgg

SEQ ID NO: 530236 - DNA, 313 bp, Homo sapiens; identical to SEQ ID NO: 444428
  misc_feature: HEFZJCU01C68V6.11.59.F04.1.454.heavy.3.raw

SEQ ID NO: 530237 - DNA, 518 bp, Homo sapiens
  misc_feature: HEFZJCU01BZJJD.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccagttaaccatctccagagacgattccgagaacacggtgtatcttcaaatgaacaacctagagagccgacgacacggccgtttattactgtgcgagagattcgagtggttcggggacctcaccctggttctacttcgatctct

SEQ ID NO: 530238 - DNA, 530 bp, Homo sapiens
  misc_feature: HEFZJCU01AZIRC.17.28.C06.1.454.heavy.3.raw
  modified_base (518)..(518): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatcctccagagacaacgccaagaattcactgtatctacaactgaacagcctgagagtcgcagcacggccgtgtatactgtgcgagatgtgaaaagtatggctgtgtttatggggcagggancctggtctaccg

SEQ ID NO: 530239 - DNA, 526 bp, Homo sapiens
  misc_feature: HEFZJCU01AF6MF.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattgactactgggccagggaaccctggtcaccgtctcctcacgcctcacc

SEQ ID NO: 530240 - DNA, 515 bp, Homo sapiens; identical to SEQ ID NO: 452925
  misc_feature: HEFZJCU01A50CF.12.25.C03.1.454.heavy.3.raw

SEQ ID NO: 530241 - DNA, 499 bp, Homo sapiens
  misc_feature: HEFZJCU01A642W.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatggggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctgggccgtggcaccctggtcactgtctcctcggccttccaccagggcccatcggtcttcccctggcgccctgctc

SEQ ID NO: 530242 - DNA, 508 bp, Homo sapiens
  misc_feature: HEFZJCU01C4YX3.48.82.H05.1.454.heavy.3.raw
  modified_base (307)..(307): a, c, t, g, unknown or other
  modified_base (461)..(461): a, c, t, g, unknown or other
agtatacatacacgaccggtgctcgatttagtcgagctctctcgcgggcacgaccggtgctcgatttagatagctctcgttgggtttgggggggtccctgagactctcttgtgcagcctctggattcagctttagtaattatgccatgagctgggtccgccaggctccagggaagggggctggagtggatttcatctattagtggtagtggtgttaccacatactacgcagactccgtgaagggccgattcatcatctccagagacagttccaggaacacactggatttgcaaatgaacagcctganagccgaggacacggccctatattactgtgcgaaatcccatgatagtagtggttttttcttttcgttctttgaccactggggccagggatccctgctcaccgtctcctcagcctccaccaagggcccatcggtcttcccctggcgcctgctcagngcacctccgagagcacagcggccctgggctgcctggtcaaggctact

SEQ ID NO: 530243 - DNA, 417 bp, Homo sapiens
  misc_feature: HEFZJCU01CTWZU.40.81.H04.1.454.heavy.3.raw
  modified_base (305)..(305): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggggtttnagtggatggggtggatcaaccctaccagaggtggcacaaagtatcgacagaactttcagggcagggtcaccatgacctgggacgcgtccatcagcacagtctacatgggaat

SEQ ID NO: 530244 - DNA, 525 bp, Homo sapiens
  misc_feature: HEFZJCU01DZ5CZ.12.11.A11.1.454.heavy.3.raw
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaacgccgaaggacacggctgtgtatttctgtgcgaggacgtccgtaggtgactaaattttataccaaaccagactaaagtttccg

SEQ ID NO: 530245 - DNA, 520 bp, Homo sapiens
  misc_feature: HEFZJCU01EJ5MG.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 530246 - DNA, 550 bp, Homo sapiens
  misc_feature: HEFZJCU01AJJAY.17.34.D01.1.454.heavy.3.raw
  modified_base (417)..(417): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatactggagcngaacagcctgtcatctgaggacacgggcttctacttctgtgcgaggagtaattactataactatgcttcctttttacctacccttccctttcgacctttcgtcgggggtccacgtcgggtaaccccggtaccg

SEQ ID NO: 530247 - DNA, 513 bp, Homo sapiens
  misc_feature: HEFZJCU01EBGL4.53.78.H01.1.454.heavy.3.raw
cgcgtatacacacgaccggtgctcgatttagtgtgagtagtttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgagttcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaacccgtggtcaccgtctcctcagcttccaccaaggcccatcggtccttcccctcggccgcctcg

SEQ ID NO: 530248 - DNA, 556 bp, Homo sapiens
  misc_feature: HEFZJCU01ER3JC.48.78.H01.1.454.heavy.3.raw
  modified_base (528)..(528): a, c, t, g, unknown or other
agtatacatacacgaccggtgctcgatttagtgtgagtagtttgggtttggggggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactacctccaacttcggctttggacatcgtgggggccaaggggacctcgggtccgccgttttccncacgtccctccaaccaacgggccctacg

SEQ ID NO: 530249 - DNA, 506 bp, Homo sapiens
  misc_feature: HEFZJCU01D5TIT.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctgggagtgggtctcatccattagtagtagtagtagttacatatactacgcagactcagtgaagggcccgattcaccatctccagagacaacgccaagaactcactgtatctgcaaatgaacagccctgagtagccgaggacacggctgtgtattactgtgcgagtttgtttgggcgggatagcagcgggtacc

SEQ ID NO: 530250 - DNA, 518 bp, Homo sapiens
  misc_feature: HEFZJCU01ASRDL.51.21.B10.1.454.heavy.3.raw
cgatcgtatacacgaccggtgctcgatttagtgtcgtcgcaagggggagggcatcatccaacaaccacatcccttctctacagaagcctctgagaggaaagttctttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaaggatcaaccctagtggtggtaccacaagttacgcccagaaattccaggggcagagtcctccatgaccagaaatacgtccgcgaggacagtctacatggagttgagcagcctgagaactgacgacaccggccatatattactgtgcgagagaccttgcgtggtccttttgacttctcggggccagggaaccctggtctaccg

SEQ ID NO: 530251 - DNA, 516 bp, Homo sapiens
  misc_feature: HEFZJCU01DDOZA.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcacctatctccagagacttttctcagtaacacactgtctcttcaaatgaacagcctgagggccgaggacacgggcccgtcgtaattattgtggtgagtaggttttatggggcgatggcttgggtggacaggat

SEQ ID NO: 530252 - DNA, 500 bp, Homo sapiens
  misc_feature: HEFZJCU01CEPM9.11.71.G05.1.454.heavy.3.raw
  modified_base (494)..(494): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgactgtatctgcaaatgaacagcctgagagctgaggacacggctgtgtattactgtgcgaaagatttctatagaggtnacgtac

SEQ ID NO: 530253 - DNA, 503 bp, Homo sapiens
  misc_feature: HEFZJCU01BBM80.17.10.A10.1.454.heavy.3.raw
  modified_base (450)..(450): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcganaatgttttctgtcatcgtactaatttgataggctctatggactggacttcgtc

SEQ ID NO: 530254 - DNA, 530 bp, Homo sapiens
  misc_feature: HEFZJCU01BDMC5.53.10.A10.1.454.heavy.3.raw
cgcgtatacacacgaccggtgctcgatttagcgtcgatctcagggtcttcgtggctcacgtccaccaccacgcatgtgacctcagggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttgggggtttcgaccccgtggggcccagggaaccctggtcaccgtctcctcagcctccaccaagggcccatcggtcttcccctggcaccctcctccaagagcacctctgggggcacgagcc

SEQ ID NO: 530255 - DNA, 511 bp, Homo sapiens
  misc_feature: HEFZJCU01B4XS3.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtcgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcaggcggtccctttgacctttcgtc

SEQ ID NO: 530256 - DNA, 547 bp, Homo sapiens
  misc_feature: HEFZJCU01D760H.40.44.D11.1.454.heavy.3.raw
tctagcgactcacgaccggtgctcgatttagcgcagtacgaagggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgccagcccccagggaaggggctggagtggattggggaaatcaatcatagtggaagcaccaactacaacccgtcactcaagagtcgactcaccatatcagtagacacgtccaagaaccagttctcctgaagctgagctctgtgaccgccgcggacacggcctgtgtattactgttgcgagaggcttggtgcagtgggctcccggggcgttttgacttacgtggggccgagggaaccccgtacggtcaccggtccttccctctacgcccttccaacccgaacggggccccgaacgttcc

SEQ ID NO: 530257 - DNA, 505 bp, Homo sapiens
  misc_feature: HEFZJCU01DXSGS.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagtggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggacgtggacctacgtcgacgactacggcactgtattactgtggaagagtacgttggtggctacggcgggctgaccacgtgggccg

SEQ ID NO: 530258 - DNA, 505 bp, Homo sapiens
  misc_feature: HEFZJCU01ASN6U.10.38.D05.1.454.heavy.3.raw
  modified_base (439)..(439): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctganagtcgacgacacggccacctattattgtgcgcgacatgactacgctcaattctggggccagggacg

SEQ ID NO: 530259 - DNA, 535 bp, Homo sapiens
  misc_feature: HEFZJCU01D7VHZ.48.73.G07.1.454.heavy.3.raw
agtatacatacacgaccggtgctcgatttagctctacgctcagggcacgaccggtgctcgatttagacgcgatcgaagggtttgggggggagaggagcccagcactgggattccgaggtgtttccattcggtgatcagcactgaacacagaggactcaccatggagttttggctgaggtgtccagtgtgaggtgtagctggtggagtctggaggaggcttgccccagcctgggaggtccctaagactttcctgtgcagcctctgggtttagtgtcactagtaggaagatgacttgggtccaccaggctccagggaaggggctggagcgggtcgcaattctttacagtggtgttaggacaacctacgcagactccgtgaaggggcgattcaccttctccagaggcaattccaagaacaccctgtgtcttcgtggtctcatttctttatagcggtgttaggacaacctacgcagactccgtgaaggggcgattcaccttctccagaggcaattccaagaaccacctgtatcttcaaa

SEQ ID NO: 530260 - DNA, 530 bp, Homo sapiens
  misc_feature: HEFZJCU01AL24O.17.23.C01.1.454.heavy.3.raw
cgtagactagcacgaccggtgctcgatttagtacacgtgattagggattgggggagagaggagccttagccctagattccaaggcctatccacttggtgatcagcactgagcaccgaggattcaccatggaactggggctccgctgggttttccttgttgccctttttggaggtgtccaatgtgaggtgcagctggtggaatctgggggaggcctggtcaagcctggggggtccctgagactctcctgtacagcctctggattcaccttcaagaactacaacatgcactgggtccgccaggctccagggaagggactggagtgggtctcatccattagtagtggaagtagttacatatattccgcagagtcagtgaagggccggttcaccatctccagagacaacgccaagaactcactctttctgcaaatgaacggcctgggacccgaagacacggctgtctatttctgtgcgagagacgggggagtagtaactgctgtaggtaggtctaagttttggctactatctac

SEQ ID NO: 530261 - DNA, 540 bp, Homo sapiens
  misc_feature: HEFZJCU01EFK6P.13.38.D05.1.454.heavy.3.raw
tcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtggggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagtcgactacgtcggggcccgggaacg

SEQ ID NO: 530262 - DNA, 523 bp, Homo sapiens
  misc_feature: HEFZJCU01DUFQ9.3.17.B06.1.454.heavy.3.raw
  modified_base (430)..(430): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccaactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttanctgcaatgaacagcctgagaaccgacgacacggccgtctattattgtgtcatagacctaaggatacaacgtacgggtggtacctggtaattcc

SEQ ID NO: 530263 - DNA, 501 bp, Homo sapiens; identical to SEQ ID NO: 457766
  misc_feature: HEFZJCU01A9OWJ.11.27.C05.1.454.heavy.3.raw

SEQ ID NO: 530264 - DNA, 513 bp, Homo sapiens
  misc_feature: HEFZJCU01C0738.10.85.H08.1.454.heavy.3.raw
  modified_base (501)..(501): a, c, t, g, unknown or other
catagtagtgcacgaccggtgctcgatttagtatcactcagtcgcggggctcagagaggagccttagccctggactccaaggcctctccacttggtgatcagcactgagctgggttttccttgttgttatttttagaaggtgtccaatgtgaggagcagctggtggagtctgggggaggcctggtccagccgggggggtccctgagactctcctgtggagcgtccggattcgctttaaaaaagtacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctagtggtcggactcgtgggccagggaaccctggtcacgtctacntcagccctcacc

SEQ ID NO: 530265 - DNA, 495 bp, Homo sapiens
  misc_feature: HEFZJCU01DEJTT.48.86.H09.1.454.heavy.3.raw
  modified_base (452)..(452): a, c, t, g, unknown or other
  modified_base (457)..(457): a, c, t, g, unknown or other
  modified_base (463)..(463): a, c, t, g, unknown or other
  modified_base (465)..(465): a, c, t, g, unknown or other
  modified_base (469)..(469): a, c, t, g, unknown or other
agtatacatacacgaccggtgctcgatttagtgctatagacttgggtttgggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgnagtgntttgtntncttnatatgtgggcaggacatgtacacgtc

SEQ ID NO: 530266 - DNA, 520 bp, Homo sapiens
  misc_feature: HEFZJCU01CEIZU.49.19.B08.1.454.heavy.3.raw
agtcgagagacacgaccggtgctcgatttagtgagtcagtaaggggctgagagaggagcccagccctgggattttcaggtgttttcatgtggtgatcaggactgaacagagagaactcaccatggagtctgggctgacgtggcttttgcttgtggctatcttaaaaggtgtccagtgtgacgtgcagttggtggagtcggggggaggcttggtacagccgggggggtccctgagactctcctgtacagtctctggcttcacctttagagtctatgacatgagttgggtccgccaggctccggggaaggggctggagtgggtctcaacgatcagtgatagtggaactaagacaaactatgccgactccgtgaagggccgatgcaccatctccagagacaactcgaaggacactttatatctgcaactcaacagactgacaaccgcggacgcggccgtctattactgtgtgaaagaagacggaccgctggacgaggagccagaggaaaatcaactacttaga

SEQ ID NO: 530267 - DNA, 507 bp, Homo sapiens
  misc_feature: HEFZJCU01CSKM1.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaacccaggtggtccttacaatgaccaatatggaccctgtgacacagccacatattactgttcacgctctatggttcggggagttattagtccctactttgactacgtgggcagggactctggtcacgtctccgcagcctcaccaggccc

SEQ ID NO: 530268 - DNA, 523 bp, Homo sapiens
  misc_feature: HEFZJCU01BK3ND.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgattatatggggccagggggacagcggtcaccgtctcttca

SEQ ID NO: 530269 - DNA, 537 bp, Homo sapiens
  misc_feature: HEFZJCU01AX98X.48.43.D10.1.454.heavy.3.raw
agtatacatacacgaccggtgctcgatttagactagcagtaagggggtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgacgccgtggggccgaggaaaaactggtcaccgtctcctcagcttccaccaagggcccatcggtcttccccctggccgccct

SEQ ID NO: 530270 - DNA, 530 bp, Homo sapiens
  misc_feature: HEFZJCU01B0E2Q.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcggagacggtcccaacggacttcccggggtgtaacgcccgtaacggccaggccgggtccttttaggacctttcgtc

SEQ ID NO: 530271 - DNA, 505 bp, Homo sapiens
  misc_feature: HEFZJCU01DSELO.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggccccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggcccctcccacatcggttacttttctttgtacttcctgggggacccaggggaacccctggtcctaccgtctcctcc

SEQ ID NO: 530272 - DNA, 502 bp, Homo sapiens
  misc_feature: HEFZJCU01ANREP.49.52.E08.1.454.heavy.3.raw
agtcgagagacacgaccggtgctcgatttagtcgagctctcccgcggggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccgagggaagggactggagtgggtttcatacattagtcggagagtcaacaccgtattctacacagactctgtggaggggccgattcaccatctccagagacaacgccaagaactcactgtatctccaaatgaacagcctgagagtcgaggacacggctgtctattactgtgcgagagactacccaacagcggctggttac

SEQ ID NO: 530273 - DNA, 521 bp, Homo sapiens
  misc_feature: HEFZJCU01A0J58.53.35.D02.1.454.heavy.3.raw
cgcgtatacacacgaccggtgctcgatttagcacacgatagttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttatactgtgcgaacttaattacggaggacaacggtaaccccgtcgcacggtacggtacg

SEQ ID NO: 530274 - DNA, 314 bp, Homo sapiens; identical to SEQ ID NO: 444774
  misc_feature: HEFZJCU01EYD5B.7.10.A10.1.454.heavy.3.raw

SEQ ID NO: 530275 - DNA, 409 bp, Homo sapiens
  misc_feature: HEFZJCU01CN7GF.11.63.F08.1.454.heavy.3.raw
cgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggag

SEQ ID NO: 530276 - DNA, 398 bp, Homo sapiens
  misc_feature: HEFZJCU01EST3R.18.61.F06.1.454.heavy.3.raw
tacgagtatgcacgaccggtgctcgatttagctacgctctaagggaaaggggctggagtggttgagttttatatcatatgatggaggttacaaatattatgcagagtccgtgaagggccgattcatcatctccagagacaactccaagaacacactgtttctgcaagtggacagtctgagacctgaggacacggctgtatattactgtacgagagatccggggggtcacgaccactggaactactttaccttctggggccagggaaccctggtcatcgtctcctcagcctccaccaagggcccatcggtcttccccctggcgccctgctccaggagcacctccgagacgcacagcggccctgggcctgcctggtcaaggactacttcccatactcgta

SEQ ID NO: 530277 - DNA, 513 bp, Homo sapiens
  misc_feature: HEFZJCU01D5ELH.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgacaaatgaacagcctgagaaccgacgacacggccgtactattattggtgtcatagacctaggaataccaacggac

SEQ ID NO: 530278 - DNA, 515 bp, Homo sapiens
  misc_feature: HEFZJCU01D8FOW.51.26.C04.1.454.heavy.3.raw
  modified_base (447)..(447): a, c, t, g, unknown or other
  modified_base (513)..(513): a, c, t, g, unknown or other
cgatcgtatacacgaccggtgctcgatttagtctagcgactttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgagganagggctgtttattactgtgtgtcgatccgactcactggtacgggagttacttcctccgcaacggtntc

SEQ ID NO: 530279 - DNA, 529 bp, Homo sapiens
  misc_feature: HEFZJCU01DHYHR.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcacctggtacggggagttactccttccgcaacggtatggacgtctgggggccaagggaccacggtcaccgtctccttagcctccaccgaacggcccatcggtcttcccccgtggccaccctcctccaaga

SEQ ID NO: 530280 - DNA, 330 bp, Homo sapiens
  misc_feature: HEFZJCU01AOXIK.48.69.G03.1.454.heavy.3.raw
agtatacatacacgaccggtgctcgatttagtcgctgcgtaaaggagaaaggggatgctttctgagagtcatcggatctcatgtgcaagaaatgaagcacctgtaggttcttccgtcctgctggtggcggctcccagatgggtcctgtcccagctgcagtctgcagggagtcgggcccaggacctgggtgaaggccttcgggagaccctgtccctctacctggcactgtctctgggtggctccatcagcagcagtacttacttcttggggctggatccgcacgcccccagggaacggggctgggagtggagttggggagtatttaccaca

SEQ ID NO: 530281 - DNA, 516 bp, Homo sapiens
  misc_feature: HEFZJCU01D0ZPQ.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggaggtggattgggagtatttaccacagtgggagcacctactacaacccgtccctcaaaagtcgaggcaccatatccgtagacaccgtccaagaacccaattcctccctgaagctgagctctgtgaccgccgcagacacggctgtctattactgtgcggaggccccgagcgcagtggtctttttgatgtcctttgatatggtggggccgaagggacaagtaggtcaccgtt

SEQ ID NO: 530282 - DNA, 531 bp, Homo sapiens
  misc_feature: HEFZJCU01BYAIP.7.78.H01.1.454.heavy.3.raw
  modified_base (518)..(518): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattgactactggggccagggaaccctggtcaccgtctcctcngcctccacaacgg

SEQ ID NO: 530283 - DNA, 519 bp, Homo sapiens
  misc_feature: HEFZJCU01EDP2N.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccaggggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccaacgaacgttactacgctagtggacgtcgtggggaccg

SEQ ID NO: 530284 - DNA, 398 bp, Homo sapiens
  misc_feature: HEFZJCU01BOEH3.10.42.D09.1.454.heavy.3.raw
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaaggggctggttacatgttttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 530285 - DNA, 513 bp, Homo sapiens
  misc_feature: HEFZJCU01BXP03.53.85.H08.1.454.heavy.3.raw
cgcgtatacacacgaccggtgctcgatttagtatcactcagtcgcgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaactataggtgactccgtgaagggccgattctccgtctccagagacaattccaagaacaccttgtatctgcaaatgaacagcctgagatatgaggacacggctctgtattactgtgcgaaagaaaggttaactgtaggagagtgggagttattcgtt

SEQ ID NO: 530286 - DNA, 501 bp, Homo sapiens
  misc_feature: HEFZJCU01EZ4NR.3.26.C04.1.454.heavy.3.raw
  modified_base (442)..(442): a, c, t, g, unknown or other
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaacgaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtccttcccctggcgcctcnctccaggagcacctccgagagcacacgcggccctgggctgcctcggtcaaggactaccg

SEQ ID NO: 530287 - DNA, 503 bp, Homo sapiens
  misc_feature: HEFZJCU01BOD84.40.7.A07.1.454.heavy.3.raw
tctagcgactcacgaccggtgctcgatttagcacgtgtcgcaggggacccaacaaccacatccctcctcagaagcccccagagcacaactccttaccatggactggacctggaggatcctctttttggtggcagcagccacaggtgtccactcccaggtccagcttgtgcagtctggggctgaggtgaagaagcctggggcctcagtgaaggtttcctgcacggcttctggatacaccttcactagatatgctatacattgggtgcgccaggcccccggacaaagacttgagtggatgggatggatccaccctggcaattataaacacaaaaacattcacagaagttccagggcagagtcaccattaccagggacacatccgcgagcacagtctacatggagctgagcagcctgagatctgaagacacggctgtgtattactgtgcgacgaattagtggctggcgagaggtgggatactactttgactttcgtggggccgaac

SEQ ID NO: 530288 - DNA, 508 bp, Homo sapiens
  misc_feature: HEFZJCU01D1YHL.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtgggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgt

SEQ ID NO: 530289 - DNA, 505 bp, Homo sapiens
  misc_feature: HEFZJCU01EIOED.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtagcgtagaggtttttagtgatactttattagtagtggtggtaccttgcttaccgtttttc

SEQ ID NO: 530290 - DNA, 562 bp, Homo sapiens
  misc_feature: HEFZJCU01DDFCH.48.10.A10.1.454.heavy.3.raw
agtatacatacacgaccggtgctcgatttagcgtcgatctcaggggactctgggagaggagccccagccctgagattcccaggtgtttccattcagcgatcagcactgaacacagaggactcaccatggacttgggactgagctggattttccttttggctcttttaaaaggtgcccagtgtgaagtacaactggtggagtctgggggaggcttggtgcagcctggcaggtccctgagactctcctgtgcagcctccggattcacctttgagaattttgccatgaactgggtccggcgacttccagagaagggcctggagtgggtcgcaatgattagtcgaagcaccaaaagtgtaggatatggggactctgtaaagggccgagttcaccgtgtccagagacaacgccaaaattccctgttcttgaaatgaacagtctgagacctgaggacaccggccctagtatttttagttacaaaaagaccgggaagccgaatggggggaaagttgggtaggcgaaggcgtcccttcggggctttttgtaatttcgtttcgggggtccg

SEQ ID NO: 530291 - DNA, 510 bp, Homo sapiens
  misc_feature: HEFZJCU01EJHKU.22.82.H05.1.454.heavy.3.raw
acatacgcgtcacgaccggtgctcgatttagtcgagctctctcgcggggtctgagagaggagtccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtgacgaacggtggctacgcgttta

SEQ ID NO: 530292 - DNA, 489 bp, Homo sapiens
  misc_feature: HEFZJCU01COJQK.47.85.H08.1.454.heavy.3.raw
  modified_base (485)..(485): a, c, t, g, unknown or other
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccagagcacctccgagacgcacaggcggcccgtgggctgcctggtcagactacttcctacgtnagct

SEQ ID NO: 530293 - DNA, 507 bp, Homo sapiens
  misc_feature: HEFZJCU01D12XD.10.38.D05.1.454.heavy.3.raw
  modified_base (481)..(481): a, c, t, g, unknown or other
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacattattattctgactccgtgaagggccggttcacccgtctccagagacacttccaacacatcttgtatcttcacatgcacaatctgagagtcgacgacacggccacctattattgtgcgcgacagtnacttacgctccaatttctgggggccg

SEQ ID NO: 530294 - DNA, 355 bp, Homo sapiens
  misc_feature: HEFZJCU01BXVX0.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggcctgggctgcctggtcaaggactacttcctacgtgagct

SEQ ID NO: 530295 - DNA, 516 bp, Homo sapiens
  misc_feature: HEFZJCU01B8P97.26.71.G05.1.454.heavy.3.raw
agactatactcacgaccggtgctcgatttagtgtcgtcgcaagagagaggggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagatatgactattgggccagggaatttggtcaccgtctcccagcctccaccaagggcccatcggtcttccccctggcgccctgctccaggagcacctccgagagcacacgcggccctgggctgcctggtacaggactactccta

SEQ ID NO: 530296 - DNA, 497 bp, Homo sapiens; identical to SEQ ID NO: 469272
  misc_feature: HEFZJCU01C7GSF.11.72.G06.1.454.heavy.3.raw

SEQ ID NO: 530297 - DNA, 501 bp, Homo sapiens
  misc_feature: HEFZJCU01BFE10.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaacctgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccga

SEQ ID NO: 530298 - DNA, 507 bp, Homo sapiens
  misc_feature: HEFZJCU01BOS9L.5.57.F02.1.454.heavy.3.raw
atcagacacgcacgaccggtgctcgatttagctcgatatagttgggtttggggaactctgagagaggagcccagccctgggattttcaggtgttttcatttggtgatcaggactgaacagagcgaactcaccatggagtctgggctgacctggctttttcttgtgactattttaaaaggtgtccactgtgacgtgcagatcttggagtctgggggacgcttcgagcggccggggggatccgtgagactctcctgctcaacctctggattcacatttgtcctttacgccatgacttgggtccgccaggctccagggagggggccaggagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttacttt

SEQ ID NO: 530299 - DNA, 509 bp, Homo sapiens
  misc_feature: HEFZJCU01D3CR4.52.37.D04.1.454.heavy.3.raw
cgcagtacgacacgaccggtgctcgatttagtagcatactgttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtgccagcgtgaagcatgatggaggtgaggaagactatgcggactctgtgaaggccgattcaccacttccagagacaacatcaagaactcaatgtatctccaaatgagcagcctgacagtccgaggacacggccgtgtattactgtgcgagagtttctttgggatgttgtcgttgcacg

SEQ ID NO: 530300 - DNA, 513 bp, Homo sapiens
  misc_feature: HEFZJCU01DSHZJ.10.38.D05.1.454.heavy.3.raw
  modified_base (475)..(475): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttattgaaacagatggcactacatattattctgactccgtgaagggccggttcaccctctccagagacacttccaacaaccatcttgtatcttcacatgcacaatctgagagtcgacgacacggccaacctattattgtgcgngacattgactacgctcaattctgggggcccagggtacg

SEQ ID NO: 530301 - DNA, 536 bp, Homo sapiens
  misc_feature: HEFZJCU01EI9IE.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggctttggttctggggcctagggggaccctgggtcatccgtctccccagccctccaccaacggggcccagtccggtccttcccccgtggccg

SEQ ID NO: 530302 - DNA, 481 bp, Homo sapiens
  misc_feature: HEFZJCU01CZZFT.12.5.A05.1.454.heavy.3.raw
atacgacgtacacgaccggtgctcgatttagatagatagacagggagaggctcttctgtgtgtagtggttgtgcagagcctcatgcatcacggagcatgagaagacgttcccctgctgccacctgctcttgtccacggtgaacttgctgtagaggaagaaggagccgtcggagtccagcatgggaggcgtggtccaacctggaaagtccctgagcctctcctgtgcagcctctggattcacattcagtacccgtgctatgcagtgggtgcgccaggctccaggcaaggggctggactgggtggccgttatagcacctgatggcaatgtgaagtattatgcagactccgtgaggggccgattcacgatcttaagagacaattcgaagaacactctagtatctacagatgggacagcctgagagttgaagacgacggctctttattactgtgcgagagagaattacgatttgactctcggtgt

SEQ ID NO: 530303 - DNA, 514 bp, Homo sapiens
  misc_feature: HEFZJCU01C5C3N.12.40.D07.1.454.heavy.3.raw
  modified_base (498)..(498): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaatagacagcctgagaccagacgacacggctgtctattattgcgcgagagagacacacgaacctactggccatactatggggcttgtctgggcaggggacctggtcatcgtctccccagcctccaccaacggcccancggtcttcccctggcg

SEQ ID NO: 530304 - DNA, 506 bp, Homo sapiens
  misc_feature: HEFZJCU01CXBA9.48.29.C07.1.454.heavy.3.raw
agtatacatacacgaccggtgctcgatttagagtgctacgaagggaaaggggagctctgggagaggagccccagccctgagaatcccaggtgtttccattcagtgatcagcactgaacacagaggactcaccatggagttgggactgagctggattttccttttgactattttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcgatcatctccagagacaacgccaagaactccctgtatttgcagatagaacaatctgagacctgacgacacggccttgtattattgtgacaaagttgtaggagtcacagtctgt

SEQ ID NO: 530305 - DNA, 530 bp, Homo sapiens
  misc_feature: HEFZJCU01CYM0W.48.25.C03.1.454.heavy.3.raw
agtatacatacacgaccggtgctcgatttagtagtgtagatttgggtttgggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctggggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtggagggccgattcaccatctccagagaccaacccccgaaactcttcttttctgcaatggacagcctgacagccgacgataacgggccatttattactgtgcgagagagtacggggacccccggacactactccaacgaagggcaactacctacttaactttcgg

SEQ ID NO: 530306 - DNA, 495 bp, Homo sapiens; identical to SEQ ID NO: 461957
  misc_feature: HEFZJCU01B9GUU.51.1.A01.1.454.heavy.3.raw

SEQ ID NO: 530307 - DNA, 528 bp, Homo sapiens
  misc_feature: HEFZJCU01BM07S.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgttcgtggggccaagggaccacggtcatcgtctccctcacgccctccaccgaacgggcccactcggttcctttcccccgtcggccta

SEQ ID NO: 530308 - DNA, 520 bp, Homo sapiens
  misc_feature: HEFZJCU01BGTOQ.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcacctggtcactgtctcctcggcttccaccaacgggcccatcggtcttcccctggcgcctgctccaggacgcgacctcgtcgggggcgacgagccggtcccg

SEQ ID NO: 530309 - DNA, 538 bp, Homo sapiens
  misc_feature: HEFZJCU01EQGF1.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgatttctgtgcgagtcttgatagtagtggttatcctgaatactggggccgagggaaccctggtgaccgtctcctcagcctccaccaaggcccatcggtcttcccccgtcggccgccctgcctccaggagcacctccgacgacgcacagccggcccctcggggtccg

SEQ ID NO: 530310 - DNA, 523 bp, Homo sapiens
  misc_feature: HEFZJCU01CH76Z.40.67.G01.1.454.heavy.3.raw
tctagcgactcacgaccggtgctcgatttagagtatacatattgggtttggggggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgaccgctgacgtctgtcgaccgccgcagacacggctgtctattattgtgcgagactagccttctgtagtgggggtacttgcaacccgggatactactccaccttcggcttggacatctgggccggaggggcctcggtcgtcgtttcctc

SEQ ID NO: 530311 - DNA, 501 bp, Homo sapiens
  misc_feature: HEFZJCU01ELZF2.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatgtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcagtcgtacaatttgataggctctatggactggacttctc

SEQ ID NO: 530312 - DNA, 492 bp, Homo sapiens
  misc_feature: HEFZJCU01E0TCA.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctacaa

SEQ ID NO: 530313 - DNA, 489 bp, Homo sapiens; identical to SEQ ID NO: 448271
  misc_feature: HEFZJCU01B1CD5.18.70.G04.1.454.heavy.3.raw

SEQ ID NO: 530314 - DNA, 502 bp, Homo sapiens; identical to SEQ ID NO: 456269
  misc_feature: HEFZJCU01ESA01.17.10.A10.1.454.heavy.3.raw

SEQ ID NO: 530315 - DNA, 517 bp, Homo sapiens
  misc_feature: HEFZJCU01EJYRH.22.82.H05.1.454.heavy.3.raw
  modified_base (397)..(397): a, c, t, g, unknown or other
  modified_base (480)..(480): a, c, t, g, unknown or other
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccaggggaaggggccggagtgggtgtcagtcattagtagtaggtggtgatagaatttaccacacagactccgtagaagggccgcttcaccatctntagagacaattcccagaacacactgtatctgcaaatgactaggctgagagccgacgacacggccatttatactgcgcgaaggntagtacgggtcgacgaacggtggctacgcgtttctag

SEQ ID NO: 530316 - DNA, 516 bp, Homo sapiens
  misc_feature: HEFZJCU01CJVR3.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttatagttccctactttgactactgggccagggaactctggtcaccgtctccgcagcctccacaacgggccactcc

SEQ ID NO: 530317 - DNA, 512 bp, Homo sapiens
  misc_feature: HEFZJCU01CLVML.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggtcgggacctcaccctgtctactcgatctcgt

SEQ ID NO: 530318 - DNA, 490 bp, Homo sapiens
  misc_feature: HEFZJCU01AVNZ4.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgaggcgggcctggacagtcgtggaccgacacggaccgtagtatttctgtgtcggaggg

SEQ ID NO: 530319 - DNA, 509 bp, Homo sapiens
  misc_feature: HEFZJCU01EFT4K.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctgggggccaaggggacccacggtcatcgtctcctcagcctccaccaacgggcccatcggtcttcccctggcaccctcctccaagagcacctctgggggcacagcggccctgggctgcctggtcaaggactacttcctacgtcgtat

SEQ ID NO: 530320 - DNA, 516 bp, Homo sapiens
  misc_feature: HEFZJCU01BAMY9.51.21.B10.1.454.heavy.3.raw
cgatcgtatacacgaccggtgctcgatttagtgtcgtcgcaagggggcatcatccaacaaccacatcccttctctacagaagcctctgagaggaaagttcttcaccatggactggacctggagggtcttctgcttgctggctgtagctccaggtgctcactccctggtgcagctggtgcagtcgtggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggttccttttgactttcgtcggggtccacgggaaccctggtccaccggt

SEQ ID NO: 530321 - DNA, 527 bp, Homo sapiens
  misc_feature: HEFZJCU01CGL0S.52.53.E09.1.454.heavy.3.raw
cgcagtacgacacgaccggtgctcgatttagagagagtgtgttgggtttgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagacgaacccaggggggcgggagcgacgccccgtaacttcgtggggccaggggtaacccc

SEQ ID NO: 530322 - DNA, 525 bp, Homo sapiens
  misc_feature: HEFZJCU01AU1CF.48.59.F04.1.454.heavy.3.raw
agtatacatacacgaccggtgctcgatttagtacacacacttagggattggggatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccggtccctcaaaagtcgaggcaccatatccgtagacacgtccaagaccaattctcctgaagctgagctctgtgaccgccgcagacacggctgtctattactgtgcgaggccccgagcgcagtggtcgttttgatgtcctttgattattggtggggtccgaagggaccaagtggtaccaccggtcttccgttcagccctccgaacccg

SEQ ID NO: 530323 - DNA, 485 bp, Homo sapiens
  misc_feature: HEFZJCU01ASAF1.49.27.C05.1.454.heavy.3.raw
agtcgagagacacgaccggtgctcgatttagacgcgatcgaagggtttgggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgacaaatgaacaggactgagagctgaagacacggctgtatatttactgtgacgtaacttta

SEQ ID NO: 530324 - DNA, 514 bp, Homo sapiens
  misc_feature: HEFZJCU01C3GVZ.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtggggtcgcaggtatttttataggtgggacgacattctacggagactccatggagggccgattcaccatctccagagacttttctcagaacacactgtctcttcaatgaacagctgagggccgaggacacggccgtctattattgtgtgagagttttatggcgatggcttggtggacagatcactggggccac

SEQ ID NO: 530325 - DNA, 538 bp, Homo sapiens
  misc_feature: HEFZJCU01D9I54.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccccttgggggcccggggaaccctggtccaccgtcctcccccacccctccaacccg

SEQ ID NO: 530326 - DNA, 509 bp, Homo sapiens
  misc_feature: HEFZJCU01BYWHT.10.29.C07.1.454.heavy.3.raw
  modified_base (451)..(451): a, c, t, g, unknown or other
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaagagtagaacgcgtacgtgagngtcgaggacgacgcgtcgtggtattacttcgtgtgaacgaaagtatagcggtgtaccg

SEQ ID NO: 530327 - DNA, 508 bp, Homo sapiens; identical to SEQ ID NO: 461391
  misc_feature: HEFZJCU01AIOP3.14.71.G05.1.454.heavy.3.raw

SEQ ID NO: 530328 - DNA, 533 bp, Homo sapiens
  misc_feature: HEFZJCU01CP2MP.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctgggagtgggatcgtcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccgggggaaccctggtcaccgtctccccaccctccaaccg

SEQ ID NO: 530329 - DNA, 497 bp, Homo sapiens
  misc_feature: HEFZJCU01DT5AK.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcaggatggggctttgactcctgggcccagggaaccctggtcgcggtctcctcagcctccaccaagggcccatcggtcttccccctggcaccctcctccaagagcacctctgggggcacagcggcctgggctgcctggtcaaggactacttcctacgtcgtat

SEQ ID NO: 530330 - DNA, 483 bp, Homo sapiens; identical to SEQ ID NO: 444639
  misc_feature: HEFZJCU01BZ5L3.11.23.C01.1.454.heavy.3.raw

SEQ ID NO: 530331 - DNA, 507 bp, Homo sapiens
  misc_feature: HEFZJCU01BKT89.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactacgtgggg

SEQ ID NO: 530332 - DNA, 382 bp, Homo sapiens; identical to SEQ ID NO: 516688
  misc_feature: HEFZJCU01DY88O.11.61.F06.1.454.heavy.3.raw

SEQ ID NO: 530333 - DNA, 545 bp, Homo sapiens
  misc_feature: HEFZJCU01CK44A.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggaagattcaccatctcaagagataattcaaaaacgacggtagtatttgcaatgaacagcctgaaaaccgaggacacagccgtctattactgtaccaacagattcggaagtgcatcgacgtaaaggaggactatgcttttgatatctggggcccagggacaa

SEQ ID NO: 530334 - DNA, 514 bp, Homo sapiens
  misc_feature: HEFZJCU01CN7B0.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggggctgggagtggctcgcacttatttacagtggcggcactacactactacacagacttcgcgaggggccgattccaccatctccagagacgattccaagaacacgtgtatcttcaatgaacagcctgacagtcgacgacaccggccatgtatttttgtgcgagccgaccggggcctccgtcaatggctttcatttacg

SEQ ID NO: 530335 - DNA, 484 bp, Homo sapiens; identical to SEQ ID NO: 448254
  misc_feature: HEFZJCU01A9FDL.12.75.G09.1.454.heavy.3.raw

SEQ ID NO: 530336 - DNA, 516 bp, Homo sapiens
  misc_feature: HEFZJCU01DPYHP.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccgagggcagactcaccatgaccacagacacatcagcgaacacagtcaacatggagttgcggagcctgcgatctgacgacgcggccgtatattactgtgcgagagtacgtagcggctcgttccttgactactggggcctgggaactctggtcaccgtctcc

SEQ ID NO: 530337 - DNA, 511 bp, Homo sapiens
  misc_feature: HEFZJCU01A8PRN.47.55.E11.1.454.heavy.3.raw
  modified_base (403)..(403): a, c, t, g, unknown or other
agctcacgtacacgaccggtgctcgatttagcactcgcacgttgggtttggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagngtaatactgtatctggaatgaacaatctgagagtcgacgatacggctgtctatcattgtgttttcgatgccttcggtccgcgggacttcgtggggccagggaaccctc

SEQ ID NO: 530338 - DNA, 509 bp, Homo sapiens
  misc_feature: HEFZJCU01A0BHB.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagtttgaggagcctgacatctgacgacacggccgtctattactgtgcgagagtcccacgatccggtgacgcctacggcagccggtcctttgactttcgtc

SEQ ID NO: 530339 - DNA, 517 bp, Homo sapiens
  misc_feature: HEFZJCU01CWS8R.48.78.H01.1.454.heavy.3.raw
agtatacatacacgaccggtgctcgatttagtgtgagtagtttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactgccgtgttttattgtgtcgagatccaggcgaggaggataccgatttctttatattagcgactactactacttcggaatgg

SEQ ID NO: 530340 - DNA, 505 bp, Homo sapiens
  misc_feature: HEFZJCU01D8XOV.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctggtgtattactgtgggatccctggctggcacctgtatccgaccgttggagtcagggaactctggtcaccgtctcctcagcctccaccaagggccactcggtcttcccctggcgccgtgctccaggagcacctccgagagcacagcgcc

SEQ ID NO: 530341 - DNA, 542 bp, Homo sapiens
  misc_feature: HEFZJCU01EI3HP.49.10.A10.1.454.heavy.3.raw
agtcgagagacacgaccggtgctcgattagcgtcgatctcagggggctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggcgtggtccagcccgggaggtccctcagactctcctgtacagacccgacatcttacgtcaggattaataatgtacactggatccgccaggccccaggcaaggggctggagtgggtggcattggtgactcatgtggaagacagaaattgtacgcagactccgtgaggggccgattcatcatctcaaagactactccaagaatacggtgtatcttcaaatgaatggcctcgttttgcggacacggctgtttattattgtgcgacgagggggcccccttccgtacggaggcgatcatactactttagtaccactcggggccgacgggaacccgtacc

SEQ ID NO: 530342 - DNA, 403 bp, Homo sapiens; identical to SEQ ID NO: 473669
  misc_feature: HEFZJCU01CP1ZY.10.77.G11.1.454.heavy.3.raw

SEQ ID NO: 530343 - DNA, 379 bp, Homo sapiens; identical to SEQ ID NO: 444450
  misc_feature: HEFZJCU01APHPH.47.77.G11.1.454.heavy.3.raw

SEQ ID NO: 530344 - DNA, 499 bp, Homo sapiens
  misc_feature: HEFZJCU01DPHO9.51.35.D02.1.454.heavy.3.raw
cgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgacatctccagagacaactcgaagaatacggttcttctacaaatgaacagcctgagagctagaggacacggctatgttttactgtagcgagagggtaactcggattac

SEQ ID NO: 530345 - DNA, 503 bp, Homo sapiens
  misc_feature: HEFZJCU01BLGCS.11.27.C05.1.454.heavy.3.raw
  modified_base (295)..(295): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgagggacacggctgtgtattactgtgcgagaggagctatttatctcggaaccccgat

SEQ ID NO: 530346 - DNA, 534 bp, Homo sapiens
  misc_feature: HEFZJCU01DYAIJ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaacctttcaacctgacgacactgccgtttatttttgtacgtagagcgtcgtctgtcagtggaattgactactggggccagggaaccctggtcaccgtctcctcagcctccaccacggg

SEQ ID NO: 530347 - DNA, 520 bp, Homo sapiens
  misc_feature: HEFZJCU01AYGM6.52.33.C11.1.454.heavy.3.raw
cgcagtacgacacgaccggtgctcgatttagagtgagctcgttgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgaggaggggaaagtagggtaaggtagtttttaggagttaattattatcctggcggtggcggacgtcgtc

SEQ ID NO: 530348 - DNA, 503 bp, Homo sapiens
  misc_feature: HEFZJCU01AGMAY.51.7.A07.1.454.heavy.3.raw
  modified_base (365)..(365): a, c, t, g, unknown or other
cgatcgtatacacgaccggtgctcgatttagcacgtgtcgcaggggtccgggagaggagcccagcactagaagtcggcggtgtttccactcggtgatgagcactgaacacagaggactcaccatggagttttgggctgagctgggttttcctcgttgctcttttaagaggtgtccagtgtcaggtgcacctggtggaatctgggggaggcgtggtccagcctgggaggtccctgagactctcttgtgtaggctctggattcagcttcagcaactatggcatgcactgggtccgccaggccccaggcgaggggctgcagtgggtggcagttatatcgtctgatgcaagtaatgaacattatagganaatccgtgaagggccgattcaccatctccagagacaattccaggaacacggtgtttctgtaaatgaacaggctgatacctgaggacacggctgtctattattgtgtgaagggtccgtgacaacttcggagacttccaa

SEQ ID NO: 530349 - DNA, 535 bp, Homo sapiens
  misc_feature: HEFZJCU01AXYNG.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggattgactatcggggcagggaaccctggtcaccgtctcctcacgcctccaccgacgggaccc

SEQ ID NO: 530350 - DNA, 517 bp, Homo sapiens
  misc_feature: HEFZJCU01AG574.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaactgggtgcgccaggccgctggacaacgacctgagtggatgggatgggcgaaccctaacactggtgtcacagtgtcttcacccatcctccgggacagacttaccatgaccacgaacctcctccataaacacagcctacatggagttgaggagcctgacatctgacgacacggccgtctattactgtgcgagagtcccacgatcccgggtgacggcctacggccaggccggcccttttggacctttcgtcgggggg

SEQ ID NO: 530351 - DNA, 519 bp, Homo sapiens
  misc_feature: HEFZJCU01B08IV.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaaggccgattcaccatctccagagacaattccaacaacacgctgtttctgcaaatgaacagcctgagagccgaggacacggctgtgtatcactgtgtcagagatgccgagggcggttacccctctcggttccttcgacagttatggtatggacgtctggggcctagggactacggtcaccgtctcctcagcctccaccaaggcccatcgtccttcccctcggcctacccc

SEQ ID NO: 530352 - DNA, 489 bp, Homo sapiens
  misc_feature: HEFZJCU01EX8PA.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggcctatttattactgtgcgagagatgcacgggccctaccactactcggtttta

SEQ ID NO: 530353 - DNA, 512 bp, Homo sapiens
  misc_feature: HEFZJCU01DKA2X.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgactccgggtgagcctacggccaggccggccttttgacctttctc

SEQ ID NO: 530354 - DNA, 514 bp, Homo sapiens
  misc_feature: HEFZJCU01AJ2R9.48.81.H04.1.454.heavy.3.raw
  modified_base (496)..(496): a, c, t, g, unknown or other
agtatacatacacgaccggtgctcgatttagtagtgtagattcgcgggggcatcacatagcaaccacgttcctcccctaaagaagccccgggggagcacagcccatcaccatggactggacctggaggttcctctttgtggtggcagcagctacaggtgtccggtctcaggtacagctggtgcaatctgggctgaggtgcggaagcctgggtcctcggtgagggtctcctgcaaggctcctggaggcagtttcagcatcgacgccgtcagttgggtgcgacaggccccctggacacgggcttgagtggatgggatcgatcatccctttctctaatgtcacaagatacacacagagattccagggcagaatcacacttaccgcggacaaatccacgggcacagcgcagttggacctgaggcggccgtgacgactgacgacgacggccatttactactgtggcgcggggagggtggacggagcgtcggttttacgggngttatcatctactacttt

SEQ ID NO: 530355 - DNA, 492 bp, Homo sapiens; identical to SEQ ID NO: 446706
  misc_feature: HEFZJCU01A95RW.11.71.G05.1.454.heavy.3.raw

SEQ ID NO: 530356 - DNA, 529 bp, Homo sapiens
  misc_feature: HEFZJCU01B6J3P.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagacctgtcatctgaggacacgggcttctacttctgtgcgaggagtaattactatacactgctccttttactacctcccttgacttctgggccatcggaacccgtccg

SEQ ID NO: 530357 - DNA, 499 bp, Homo sapiens
  misc_feature: HEFZJCU01CGNPB.16.34.D01.1.454.heavy.3.raw
tgtactactccacgaccggtgctcgatttagatcgtctgtgttgggtttgggggaggcttggtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaagagcacctctgggggcacgagcggccctgggctgcctggtcaaggactacttccgagtagtaca

SEQ ID NO: 530358 - DNA, 498 bp, Homo sapiens
  misc_feature: HEFZJCU01EF1FJ.10.55.E11.1.454.heavy.3.raw
  modified_base (447)..(447): a, c, t, g, unknown or other
  modified_base (460)..(460): a, c, t, g, unknown or other
catagtagtgcacgaccggtgctcgatttagcactcgcacgttgggtttgggctcaactctcttgtccaccttggtgttactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaancacggagcttttnaagttttggggccaagggacaatggtcatcgtctcctc

SEQ ID NO: 530359 - DNA, 492 bp, Homo sapiens
  misc_feature: HEFZJCU01BMHWO.9.12.B01.1.454.heavy.3.raw
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttg

SEQ ID NO: 530360 - DNA, 508 bp, Homo sapiens
  misc_feature: HEFZJCU01C31Z0.12.25.C03.1.454.heavy.3.raw
  modified_base (457)..(457): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatatactgtgcgagngtacgtagcgctcgtcctttgactactgggctggactctgtcaccgtctcc

SEQ ID NO: 530361 - DNA, 505 bp, Homo sapiens
  misc_feature: HEFZJCU01EM9X3.48.27.C05.1.454.heavy.3.raw
agtatacatacacgaccggtgctcgatttagacgcgatcgaagggtttggggatcacagaacaaccacactccctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacaggagtcacatttatggtggataaaggccacgagcacagtctacatgcagctgagcagcctgagacacaacgacacggccgtcttattattgttccaggtagaattaaatcggcgtggaaattaaagattaatgggtaa

SEQ ID NO: 530362 - DNA, 514 bp, Homo sapiens
  misc_feature: HEFZJCU01D45HS.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaacaaactgtatcttcaaataacagtctgagacttgaggacacggctgtctattactgtgcgagagactacggtgacctttctggtatttcgatctctggggccgtggcaccctggtcactgtctcctcggcttccaccaagggcccatcggtcttcccctggccgccctgctccaggagcacctctggggcacgagccggtcccg

SEQ ID NO: 530363 - DNA, 507 bp, Homo sapiens
  misc_feature: HEFZJCU01EPCAH.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaaccacgaactcctccataaacacagcctacatggagttgaggagcctgacatctgacgacacggccgtctattactgtgcgagagtcccacgatcccggtgagacctacggcagcggccttttgacttctc

SEQ ID NO: 530364 - DNA, 501 bp, Homo sapiens
  misc_feature: HEFZJCU01D6ZKV.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaaggggccgattcaccgtctccagagacaattccaggcacacgctgtatctgcaaatgaacagcctgagagctgaggacacggctgtgtattactgtgcgaaagatttctatagaggtggacgtacgggggcgttcg

SEQ ID NO: 530365 - DNA, 527 bp, Homo sapiens
  misc_feature: HEFZJCU01EJ2MQ.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactcctgtatctgcaaatgaacagcctgagagctgaggacacggccttgtatttattagttgcaaaagataccaaacccctttaccgtaactttttggtaggttggtttaacgg

SEQ ID NO: 530366 - DNA, 496 bp, Homo sapiens
  misc_feature: HEFZJCU01DT0IE.51.71.G05.1.454.heavy.3.raw
cgatcgtatacacgaccggtgctcgatttagtgtcgtcgcaagagagagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaactacgtccgcgaggacagtctacatggagttgagcagcctgagaactgacgacacggccatatattactgtgcgagagaccttgctggttcctttgtacttcgtgggtcca

SEQ ID NO: 530367 - DNA, 490 bp, Homo sapiens
  misc_feature: HEFZJCU01CJ4OI.49.34.D01.1.454.heavy.3.raw
agtcgagagacacgaccggtgctcgatttagatcgtctgtgttgggtttgggagaggagcccagcactgggattccgaggtgtttccattcagtgatctgcactgaacacagaggactcgccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgtattcaccatctccagagacaattccaagaacacactatatcttacaaatgaacactctgagacgtgaggacacggctgtctattactgtgcgactgagatgtcttatacg

SEQ ID NO: 530368 - DNA, 482 bp, Homo sapiens
  misc_feature: HEFZJCU01D1JCN.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtattttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccaggggaaccctggtcaccgtctcctcagcctccaccaaggcccatcggtcttcccctggcgccctgctccaggagcacctccgagagcacagcggcccgtgggctgcctggtcaaggactacttcccacgagagta

SEQ ID NO: 530369 - DNA, 494 bp, Homo sapiens
  misc_feature: HEFZJCU01C86B3.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaagggggctgggagtgggtggcagccatatcgtatgatgtaactaataaatactatgcagactccgtgaagggccgattcaccatctccagagacaatttcaagaacacgctgtttctgcaatgaacagcctgagagctgaggacacggctgtgttattactgtgcgaaagatatcgcggtgta

SEQ ID NO: 530370 - DNA, 545 bp, Homo sapiens
  misc_feature: HEFZJCU01AJMK2.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatgggctgtgttttattggggccgagggacgccccgtggtcctacccg

SEQ ID NO: 530371 - DNA, 490 bp, Homo sapiens
  misc_feature: HEFZJCU01A760W.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttatcgaagcgatgggactcatgaacaatatgcagactccgtgaagggccgattcatcatctccagagacaactccaacaacacactggatctccaaatgaacagcctgagagtcgaggacgacggccgtatattatttgtcgcccttgtattacta

SEQ ID NO: 530372 - DNA, 488 bp, Homo sapiens
  misc_feature: HEFZJCU01DRZHG.48.38.D05.1.454.heavy.3.raw
  modified_base (382)..(382): a, c, t, g, unknown or other
agtatacatacacgaccggtgctcgatttagtatctgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttanggttggataaagccacgagcacagtctacatgcagctgagcagcctgagacacaacgacacggccgtctattattgttccagagaataatcgcgtgaaataaagat

SEQ ID NO: 530373 - DNA, 521 bp, Homo sapiens
  misc_feature: HEFZJCU01AFQ64.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgacccacgaactcctccataaaccacagccctacatggagttgaggagcctgacatctgaccgacacggccgtctattactgtcgcgagacgtcccacgactccggtgacgcctacggcaggccggtcctttgacttcgtggggccaggggacg

SEQ ID NO: 530374 - DNA, 509 bp, Homo sapiens
  misc_feature: HEFZJCU01EV0NT.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtggaggggccgattcagcatctccagagacaacggcaagagtatactgtatctggaaatgaacaatctgagagtcgacgatacggctgtctatcattgttgttttcgatgccttcggtccgcggggacttcgt

SEQ ID NO: 530375 - DNA, 499 bp, Homo sapiens
  misc_feature: HEFZJCU01D996W.11.27.C05.1.454.heavy.3.raw
  modified_base (370)..(370): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactnactgaagggccgactcaccatctccagagacaacgccaagaactcactgtatctgcaaatgaacagcctgagagccgagacacggctgtgtattactgtgcgagaggagctattatctcggaacccgat

SEQ ID NO: 530376 - DNA, 559 bp, Homo sapiens
  misc_feature: HEFZJCU01AG8LN.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttaacgacaatccgtccctcaagagtcgagtcaccctgtccgtggacacgccgaataaccagttctccctgaaagtgacctctgtgaccgtcgcagacacggccatttattattgtgtgagatacgacttttggaatggctatgactcgatcgactactggggccctggaatccgtggtccaccgtctccctcacgcccgtcccaccgaacgggccccactccggtccctttcccccgttcggcctaccccgtt

SEQ ID NO: 530377 - DNA, 521 bp, Homo sapiens
  misc_feature: HEFZJCU01AHYC7.4.28.C06.1.454.heavy.3.raw
  modified_base (460)..(460): a, c, t, g, unknown or other
agcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccagggaagggctggtctgggtctctcgtattgatagtgatggcagtaccagaggatatgcggacgccgtgaggggccgattcaccatcttcagagacaacgccaaggacacgctgtatctggaaatgagcagtctgagacgcgaggacacggctgtgtaattcngtgcaagagaataacggcttggtacgtccctttgactacgtcgggggaccccggggacctc

SEQ ID NO: 530378 - DNA, 480 bp, Homo sapiens
  misc_feature: HEFZJCU01C4T7O.49.66.F11.1.454.heavy.3.raw
  modified_base (430)..(430): a, c, t, g, unknown or other
agtcgagagacacgaccggtgctcgatttagtcacgcgagaaggggaaaggggagctctgggagacgagcccagcactggaagtcgccggtgtttccattcggtgatcatcactgaacacagaggactcaccatggagtttggggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctagtntctgcaaatcgaacaggctgagagctgaagacacggctgtatattactgt

SEQ ID NO: 530379 - DNA, 509 bp, Homo sapiens
  misc_feature: HEFZJCU01CB88G.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggcttgacggtaaggcacagtatgcaccgaagatgaagggcagagtcacgattaccacggacacccccacgaacacagtctacatgcaactgacgagcctgagagctgacgacacggccatctacttactggtgcgaagattgttttctgtctatcgtactaatttgagtaggctctagtggacgtaggtaccttc

SEQ ID NO: 530380 - DNA, 526 bp, Homo sapiens
  misc_feature: HEFZJCU01D4CJG.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggttccttttgaccagtggggccaggggaacccctggtcaccgtctcctcagcttccaccaagggcccatcggtccttccccctcggccgccctcgctccaggagccacctccgtgggggcacagccggcccg

SEQ ID NO: 530381 - DNA, 499 bp, Homo sapiens
  misc_feature: HEFZJCU01CYYDP.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgttgaggagagtttttcggactaactccagacgaacccctgttc

SEQ ID NO: 530382 - DNA, 332 bp, Homo sapiens
  misc_feature: HEFZJCU01B4MQ7.40.81.H04.1.454.heavy.3.raw
tctagcgactcacgaccggtgctcgatttagtagtgtagattcgcgggtgtccttgggttttggggggaagaggaagactgacggtcctgccacagctggtgcagtctgtggctgaggtgaagaagcctggggcctcggtgaaggtctcctgcaagattctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 530383 - DNA, 469 bp, Homo sapiens
  misc_feature: HEFZJCU01D5N94.12.78.H01.1.454.heavy.3.raw
atacgacgtacacgaccggtgctcgatttagtgtgagtagtttgggtttggggggaagaggaagactgacggtccccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaaggcccatcggtcttccccctggcaccctcctccaagagcacctctgggggcacagcggccctgggctgcctggtcaaggactacttcctacgtcgtat

SEQ ID NO: 530384 - DNA, 512 bp, Homo sapiens; identical to SEQ ID NO: 450914
  misc_feature: HEFZJCU01CDS92.15.67.G01.1.454.heavy.3.raw

SEQ ID NO: 530385 - DNA, 505 bp, Homo sapiens
  misc_feature: HEFZJCU01B2WTM.51.36.D03.1.454.heavy.3.raw
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagcccccgggaaggggctggattggattggcagtatcagttatactgggaccaccttcttcaagtcgtcgctcaagagtcgagtcaccatgaccgcggacacgtccaagggaccagttctccctgaacgctgacctctgtgaccgccgcagacacggctttgtatttctgtgctagatataatgtggtgacagtggtgcctactacggagcttttgatatttggggccgtaaggcacgtaaggtcgaccgtctc

SEQ ID NO: 530386 - DNA, 503 bp, Homo sapiens
  misc_feature: HEFZJCU01DGP0M.13.85.H08.1.454.heavy.3.raw
  modified_base (458)..(458): a, c, t, g, unknown or other
  modified_base (464)..(464): a, c, t, g, unknown or other
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctggggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgttttattactgtncgcganataatgtcacaactggaacggtcgttttgggggtggttc

SEQ ID NO: 530387 - DNA, 517 bp, Homo sapiens; identical to SEQ ID NO: 446078
  misc_feature: HEFZJCU01CM5VH.9.34.D01.1.454.heavy.3.raw

SEQ ID NO: 530388 - DNA, 515 bp, Homo sapiens
  misc_feature: HEFZJCU01CINEA.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacggggtgtatactactgtacgaaggaggggggaaccaggcgggagttccaagtactccttgactcgtgggcc

SEQ ID NO: 530389 - DNA, 534 bp, Homo sapiens
  misc_feature: HEFZJCU01D0OOX.51.34.D01.1.454.heavy.3.raw
cgatcgtatacacgaccggtgctcgatttagatcgtctgtgttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacgggagttacttcctccgcaacggtatggacgtctggggccaagggaccacggtcaccgtctccttagcctccaccaacgggcccactcggtccttcccccgtggccaccctcctccaacgagcacc

SEQ ID NO: 530390 - DNA, 512 bp, Homo sapiens
  misc_feature: HEFZJCU01B7RZ6.43.57.F02.1.454.heavy.3.raw
  modified_base (464)..(464): a, c, t, g, unknown or other
tgtgagtagtcacgaccggtgctcgatttagctcgatatagttgggtttgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaatgaacagcctgagagccgaagacacggccgtatattactgtgcgagaggcgtcggagagtacgatattttgactggttatttgcgctactactactacgctttggacgtctggggccaagggaccacggtcaccgtctcctcagcctccaccaagggcccatcggtcttcccctgcgcctgctccaggngcacctccgagagcacagcggcctgggctgcctggtcaggactactcc

SEQ ID NO: 530391 - DNA, 532 bp, Homo sapiens
  misc_feature: HEFZJCU01EH570.48.56.F01.1.454.heavy.3.raw
agtatacatacacgaccggtgctcgatttagcagacgtctgaacacacaaaggggtctgagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaagggctggagtgggtctcaacaattagtgttagtggtgacgacagatactacgcagactccgtggagggccgcttcaccatctccagagacagccccaagaacacactgtctctggagatgatcaacctgagagccgacgacacggcagtgtattacgtgcgacgaaagaaatacaagtgggctcatcgtcgggcggccgacccacgtcggggaccg

SEQ ID NO: 530392 - DNA, 336 bp, Homo sapiens
  misc_feature: HEFZJCU01CZJIC.3.31.C09.1.454.heavy.3.raw
agacgcactccacgaccggtgctcgatttagacgtctcatcaaggaaggaagggccgattcacccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctggcgcctgctccaggagcacctccgagagcacagcggccctgggctgcctggtcaaggactacttccgagtgcgtct

SEQ ID NO: 530393 - DNA, 505 bp, Homo sapiens
  misc_feature: HEFZJCU01DRDIA.47.48.E04.1.454.heavy.3.raw
  modified_base (482)..(482): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctnacgctcggccgaccttggcttcg

SEQ ID NO: 530394 - DNA, 521 bp, Homo sapiens
  misc_feature: HEFZJCU01DRMQY.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacaggctatctattactgtgcgaaactctcattcccgttcactctgaactacgtcggggaccaggggaacccctggtccggtcccg

SEQ ID NO: 530395 - DNA, 521 bp, Homo sapiens
  misc_feature: HEFZJCU01EU6NG.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccggtctcctcagcctccaccaagggcccatcggtcttcccctggcgccctgctccaggagcacctccgagagcacagcggccc

SEQ ID NO: 530396 - DNA, 494 bp, Homo sapiens; identical to SEQ ID NO: 465564
  misc_feature: HEFZJCU01ARZOR.14.25.C03.1.454.heavy.3.raw

SEQ ID NO: 530397 - DNA, 521 bp, Homo sapiens
  misc_feature: HEFZJCU01DBX38.4.59.F04.1.454.heavy.3.raw
  modified_base (504)..(504): a, c, t, g, unknown or other
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctcctgagctgagctctgtgaccgccgcggacacggccgtgtatttctgtgcgagatcttcgtattttggagtggtaccccttggctactgggcgaggaacctggtcacgtctcttacngcctcaccaaggccacg

SEQ ID NO: 530398 - DNA, 479 bp, Homo sapiens
  misc_feature: HEFZJCU01DDHZB.4.37.D04.1.454.heavy.3.raw
  modified_base (449)..(449): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctnacgacacggccgtatatttctgtgcgaggg

SEQ ID NO: 530399 - DNA, 493 bp, Homo sapiens
  misc_feature: HEFZJCU01EI96Y.49.81.H04.1.454.heavy.3.raw
agtcgagagacacgaccggtgctcgatttagtagtgtagattcgcggggagtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtggggtgtgggctgggatccgtcagcccccaggaaaggccctggagtggcttgcactcatttattggaatgacgataagacctacagcccatctctgaagagcaggctcaccatcaccaaggacacctccaaacaaccaggtggtccttacaatgaccaacatggaccctgtggtacacagccacatattactgtgcacaccgtcccccgccgtacttattatgtatggcttagttggtttagtttcccaacgctgaattacgttcc

SEQ ID NO: 530400 - DNA, 488 bp, Homo sapiens; identical to SEQ ID NO: 494526
  misc_feature: HEFZJCU01CQ3HQ.18.70.G04.1.454.heavy.3.raw

SEQ ID NO: 530401 - DNA, 491 bp, Homo sapiens
  misc_feature: HEFZJCU01DAJKF.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtggagtccctggctggcacctgtatccgaccgttggagtcagggactctggtcaccgtctcctcagcctccaccaagggcccatcggtcttccccctggcgccctgctccaggagcacctccgagagcacagcggcccgtgggctgcctggtcaaggactacttccgtatctctcg

SEQ ID NO: 530402 - DNA, 529 bp, Homo sapiens
  misc_feature: HEFZJCU01DRFGV.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggcctacgggaaccctggtcaccgtctcctcagcctccacc

SEQ ID NO: 530403 - DNA, 497 bp, Homo sapiens; identical to SEQ ID NO: 447711
  misc_feature: HEFZJCU01DSD99.16.37.D04.1.454.heavy.3.raw

SEQ ID NO: 530404 - DNA, 516 bp, Homo sapiens
  misc_feature: HEFZJCU01DF0YH.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccagggcccatcggtcttcccctggccgccctgctcctaggacgcgacctcg

SEQ ID NO: 530405 - DNA, 481 bp, Homo sapiens; identical to SEQ ID NO: 450178
  misc_feature: HEFZJCU01DWFT9.7.10.A10.1.454.heavy.3.raw

SEQ ID NO: 530406 - DNA, 518 bp, Homo sapiens
  misc_feature: HEFZJCU01A16SC.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcacccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgtcgagagatgggggccacgaacgttactacgctatggacgtcgtcgggg

SEQ ID NO: 530407 - DNA, 516 bp, Homo sapiens
  misc_feature: HEFZJCU01DCGMS.12.25.C03.1.454.heavy.3.raw
  modified_base (486)..(486): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactacnggggcctgggaactcgtggtcaccgtctcc

SEQ ID NO: 530408 - DNA, 484 bp, Homo sapiens
  misc_feature: HEFZJCU01CSEKH.49.27.C05.1.454.heavy.3.raw
agtcgagagacacgaccggtgctcgatttagacgcgatcgaagggtttggggctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctaggagagctagaagacacggctgtatattactgtgcgtaactt

SEQ ID NO: 530409 - DNA, 511 bp, Homo sapiens
  misc_feature: HEFZJCU01EG1XU.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaggcccatcggtcttcccctggccaccctcctccaagagcacctctgggggcacagcggccctgggctgcctggtcaaggactacttccgagtgcgtct

SEQ ID NO: 530410 - DNA, 489 bp, Homo sapiens
  misc_feature: HEFZJCU01CSQNI.52.19.B08.1.454.heavy.3.raw
cgcagtacgacacgaccggtgctcgatttagtgagtcagtaagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctggaagacgacggctttatatttactgtgacgaactttaatcaac

SEQ ID NO: 530411 - DNA, 521 bp, Homo sapiens
  misc_feature: HEFZJCU01C2BJ0.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagccctctggactcaccttcacgctcaatggccactacgtggactgggtccgccaggctccagggaaggggctggagtgggttggccgttctaggagacacaactaacagtgacaccgcacaatacgccgcgtctgtgaaaggcagattcaccatctcaagagatgattcagagaactcactttatctgcaatgaacagcctgagaaccgacggacacgggccctcgtattattgtgtcatagcctaggatacaacgacggtggtacctggtattc

SEQ ID NO: 530412 - DNA, 529 bp, Homo sapiens
  misc_feature: HEFZJCU01E2BLS.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtatggctgtgtttatggggcgagggagcctggtcaccgtc

SEQ ID NO: 530413 - DNA, 499 bp, Homo sapiens
  misc_feature: HEFZJCU01CJ5GH.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctggacggacacggctgtgtattacgtggtgggagagagtggaggtcgatattggta

SEQ ID NO: 530414 - DNA, 494 bp, Homo sapiens
  misc_feature: HEFZJCU01A72H3.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctgcgccctgctccagagcacctc

SEQ ID NO: 530415 - DNA, 480 bp, Homo sapiens
  misc_feature: HEFZJCU01CPU35.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcgacccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggacctacttccgagtagtaca

SEQ ID NO: 530416 - DNA, 516 bp, Homo sapiens
  misc_feature: HEFZJCU01BW7CR.49.81.H04.1.454.heavy.3.raw
agtcgagagacacgaccggtgctcgatttagtagtgtagattcgcgggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaaagaacacgctatatttgcaacatagaacagcctgagagctgaggaccacggctatttattactgtgcgaacttaatacacgggagacaaggggtcgacccccgta

SEQ ID NO: 530417 - DNA, 516 bp, Homo sapiens
  misc_feature: HEFZJCU01AWJNW.11.13.B02.1.454.heavy.3.raw
  modified_base (441)..(441): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctcnccaagggccatcggtcttcccctggcgccctgtctccaggagcgacctccgagagcacagcggcccgtcgggctc

SEQ ID NO: 530418 - DNA, 491 bp, Homo sapiens; identical to SEQ ID NO: 447491
  misc_feature: HEFZJCU01BBB45.4.57.F02.1.454.heavy.3.raw

SEQ ID NO: 530419 - DNA, 485 bp, Homo sapiens
  misc_feature: HEFZJCU01AOYK6.51.80.H03.1.454.heavy.3.raw
cgatcgtatacacgaccggtgctcgatttagctgtgcgtcgaagggaaagggggcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtcccccatcgagaggccttgagttgctgggaaggacatactacaggtccaagttggtttaatgattatgcagtatctgtgaaaagtcgaataaccataccaacccagacacatccaagaaccagttctccctgcaactgaactctgtgactcccgaggacacggccgtgtattactgtgcaaggtaggttggttaac

SEQ ID NO: 530420 - DNA, 490 bp, Homo sapiens
  misc_feature: HEFZJCU01AXEJJ.51.1.A01.1.454.heavy.3.raw
cgatcgtatacacgaccggtgctcgatttagacgtctcatcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttggaggacacggctgtgttattattgtgcgtaacttaatcgtaac

SEQ ID NO: 530421 - DNA, 492 bp, Homo sapiens; identical to SEQ ID NO: 508423
  misc_feature: HEFZJCU01B6WFM.11.13.B02.1.454.heavy.3.raw

SEQ ID NO: 530422 - DNA, 507 bp, Homo sapiens
  misc_feature: HEFZJCU01B8RTX.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtactactttgacttctggggccagggaaccctggtcaccgtctcctcagcctccaccaagggcccatcggtcttcccctggcgccctgctccaggagcacctccgagacgcacacgccggccctgggctgcctggtcaggactacttccagacgtatca

SEQ ID NO: 530423 - DNA, 519 bp, Homo sapiens; identical to SEQ ID NO: 444867
  misc_feature: HEFZJCU01DD9BH.9.34.D01.1.454.heavy.3.raw

SEQ ID NO: 530424 - DNA, 507 bp, Homo sapiens
  misc_feature: HEFZJCU01A3JZ8.40.81.H04.1.454.heavy.3.raw
tctagcgactcacgaccggtgctcgatttagtagtgtagattcgcggggacacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccactggggccagggaaccctggtcaccgtctcc

SEQ ID NO: 530425 - DNA, 491 bp, Homo sapiens
  misc_feature: HEFZJCU01EEBYZ.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctcggcaccctcctccaagagcacctctgggggcacagcggccctgggctgcctggtcaaggactactccgagtgcgtct

SEQ ID NO: 530426 - DNA, 497 bp, Homo sapiens; identical to SEQ ID NO: 459618
  misc_feature: HEFZJCU01D0ZN5.48.77.G11.1.454.heavy.3.raw

SEQ ID NO: 530427 - DNA, 522 bp, Homo sapiens
  misc_feature: HEFZJCU01C7HXI.49.37.D04.1.454.heavy.3.raw
agtcgagagacacgaccggtgctcgatttagtagcatactgttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaaggtcgtcatgggatttgactatcggggccaggggaaccccggtcaccggtctcctctgcctcc

SEQ ID NO: 530428 - DNA, 538 bp, Homo sapiens
  misc_feature: HEFZJCU01EIU06.16.86.H09.1.454.heavy.3.raw
  modified_base (405)..(405): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagtctgacctttgngactgccgcggacacggccgtgtattactgtgcgagagacccctccgatagcagtgctggtccacgtaggttttgacttacgtggggcccaggggaaacgctttggtcaccggttctcctcgagccctacccg

SEQ ID NO: 530429 - DNA, 494 bp, Homo sapiens
  misc_feature: HEFZJCU01AN7X0.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttctagggcgtgggtcaccatgaccagcgacacatctagcaacacagtctacatggagttgaccagcctcgaccgacacggccgtgtatttttgtgtgagagattttcggactaataccagacgaccccgt

SEQ ID NO: 530430 - DNA, 511 bp, Homo sapiens
  misc_feature: HEFZJCU01A4XPE.12.1.A01.1.454.heavy.3.raw
atacgacgtacacgaccggtgctcgatttagacgtctcatcaggggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactactggggccagggaaccctggt

SEQ ID NO: 530431 - DNA, 484 bp, Homo sapiens
  misc_feature: HEFZJCU01BOAEP.53.33.C11.1.454.heavy.3.raw
  modified_base (465)..(465): a, c, t, g, unknown or other
  modified_base (477)..(477): a, c, t, g, unknown or other
cgcgtatacacacgaccggtgctcgatttagagtgagctcgttgggtttgggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagtaacacactgtatctgcaaatggacagcctgagagctgaagcacggctgtgtattacngtgcgagtgagntgtctta

SEQ ID NO: 530432 - DNA, 530 bp, Homo sapiens
  misc_feature: HEFZJCU01EV312.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattccaccatctcaagagatgattcaaaaagcacgctgtatctgcaaatgaacagcctgagaaccgaggacacagccgtgtattactgtaccacatccctgaaagcgtcaactactactactacggtataggacctct

SEQ ID NO: 530433 - DNA, 411 bp, Homo sapiens
  misc_feature: HEFZJCU01ETHA1.52.53.E09.1.454.heavy.3.raw
cgcagtacgacacgaccggtgctcgatttagagagagtgtgttgggtttgggtccggcagccccccgggaagggcctggagtggattggagatatctactacagcgggggcaccagctacagtccctccctcaagagtcgagttggcatattcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 530434 - DNA, 515 bp, Homo sapiens
  misc_feature: HEFZJCU01DO8TJ.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaccagttctgcacaaaagttccagggcagactcaccctgactacagacgcatcaacgggctcagccttcatgaccctgaggaacctgagacctgacgacgcggccatctattactgtgcgagagatgggtggcagctcgtctcaggaattgacttctggggcccgggaaccctgatctaccg

SEQ ID NO: 530435 - DNA, 539 bp, Homo sapiens
  misc_feature: HEFZJCU01AKBCT.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgacggctgagctctgtgacagccgcggacacgggcgtttattactgtgcgagagggacggactacggtgactacgtgggggttaccgccccggtggggccgacgggaacccgtcggtcaccggtctcctcacgccctccaaccg

SEQ ID NO: 530436 - DNA, 521 bp, Homo sapiens
  misc_feature: HEFZJCU01AOYUF.7.28.C06.1.454.heavy.3.raw
  modified_base (386)..(386): a, c, t, g, unknown or other
  modified_base (456)..(456): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaagggagacctactatttggactctgtgaggggccgattcatcattctccaganacaacgccgacaactcactgtctctgctgatgagcagcctgagagccgacgacacggctatctattactntgcgaaactctcatttccgttcattctgaatacgtggggccacggggaaccctgggtccgtcccg

SEQ ID NO: 530437 - DNA, 519 bp, Homo sapiens
  misc_feature: HEFZJCU01AJPNK.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaacctcctccataaacacagcctacatggagttgaggagtcctgacatctgacgacacggccgtctattactgtgcgagacgtcccgacgagtccggtgacgccctacggccaggccggccgttttgacctttcgtc

SEQ ID NO: 530438 - DNA, 535 bp, Homo sapiens
  misc_feature: HEFZJCU01B9FIJ.49.25.C03.1.454.heavy.3.raw
  modified_base (430)..(430): a, c, t, g, unknown or other
  modified_base (441)..(441): a, c, t, g, unknown or other
  modified_base (459)..(459): a, c, t, g, unknown or other
  modified_base (497)..(497): a, c, t, g, unknown or other
agtcgagagacacgaccggtgctcgatttagtagtgtagatttgggtttgggggctctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttcngcaaatgaacngcctgagaatcgaggacncggccgtatattactgtgtagaaagaagtatggaccgngtggacgagggtacgcccgtacgggccgggtccttacg

SEQ ID NO: 530439 - DNA, 516 bp, Homo sapiens
  misc_feature: HEFZJCU01BU6GK.22.41.D08.1.454.heavy.3.raw
  modified_base (325)..(325): a, c, t, g, unknown or other
acatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttntaagggaaacacaaactatgcagagaggctccagggcagagtcaccatgaccgcagacacaccaacgaccacagcctacatggagttgaggagtctgagcctgacgacacggccgtatattactgcgcgaggagggtcgtttcgtacggtgactatgagtatctcaggccagtcggggccaggggcaaccc

SEQ ID NO: 530440 - DNA, 510 bp, Homo sapiens
  misc_feature: HEFZJCU01EMI3I.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtggggtggggtgggtcagcgcttaccaagttggctacacaaattatgcacagaagttccaggacagagtcaccatgaccacagacacatccacgagcacagcctacatggaactcgaggagcctgagatctgacgacaccggccgtatatttctgcgcgagagacgtaaagtgacgtggtagttccggggggacaccatgacaccg

SEQ ID NO: 530441 - DNA, 515 bp, Homo sapiens
  misc_feature: HEFZJCU01DU4RA.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccgagctacaacccctccctcaagagccgcgtcaccatttcagtagacacgtccaagaaccagctctccctgaagctgagttctgtgaccgccgcagacacggccgtgtattactgtgcgcgacaggtggacgtcgtggggccaagggaccacggtcaccgtctcctcagccctccaccgaacgggcccagtcc

SEQ ID NO: 530442 - DNA, 552 bp, Homo sapiens
  misc_feature: HEFZJCU01EIQEU.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggagtacggggtagtttggttccgtcgggccgacgggaacccgtggtcgtaccg

SEQ ID NO: 530443 - DNA, 504 bp, Homo sapiens
  misc_feature: HEFZJCU01BOWZF.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctcgacgacaacggccgtctattactgtgcgagaatgttttctgtcatcgtacaatttgataggctctatggactggacttcgtc

SEQ ID NO: 530444 - DNA, 509 bp, Homo sapiens
  misc_feature: HEFZJCU01D0SG7.53.61.F06.1.454.heavy.3.raw
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtggaagggccgattcaccatctcgagagacaattccaggaacacgctgtatctgcaaatgaacgcctgagagctgaggacacggctgtgtattactgtgacgtaaacggtttgagtgggaagttaggggtcg

SEQ ID NO: 530445 - DNA, 500 bp, Homo sapiens
  misc_feature: HEFZJCU01ENHRP.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaacgggccgattcaccatctccagagacaattccaagaacacgcagtatctgcaaatgaacagcctagagagctgaggacacggctgtgttatttactgtggggagagagtgggaggtcgatattgta

SEQ ID NO: 530446 - DNA, 512 bp, Homo sapiens
  misc_feature: HEFZJCU01AFGWJ.48.34.D01.1.454.heavy.3.raw
agtatacatacacgaccggtgctcgatttagatcgtctgtgttgggtttgggggctctgggagacgagcccagcactggaagtcgccggtgtttccattcggtgctcagcactgaacacagaggactcaccatggagtttgggctgaactggggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgtagtttaacacgccgtcgggaac

SEQ ID NO: 530447 - DNA, 517 bp, Homo sapiens
  misc_feature: HEFZJCU01CUDY1.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagacactctatttcttcaaatggacagcctgaaagacgaagacacgggcgtgtattttgtgtgaaagatacgaagtctatgataccaattgggaggggcctttcat

SEQ ID NO: 530448 - DNA, 540 bp, Homo sapiens
  misc_feature: HEFZJCU01EWBWS.17.28.C06.1.454.heavy.3.raw
  modified_base (526)..(526): a, c, t, g, unknown or other
cgtagactagcacgaccggtgctcgatttagagctcacgtattgggtttggggaggtctcagagaggaggcttagacctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttagttggggccaggggacncccgtggtctaccg

SEQ ID NO: 530449 - DNA, 535 bp, Homo sapiens
  misc_feature: HEFZJCU01AU9ZM.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaagggctggagtgggtaggtttcattagagccatggcttatgcgtgggacaacagaatacgccgcgtctgtgaaggcagattcatcatctcagagatgattccaacggcatcgcctatctgcagactgaacagcctaggaacgaccggaggacacagcccgtctattactgtggttaggggtagtttttacgtagtttttggtaggttggtaattatttaaaccc

SEQ ID NO: 530450 - DNA, 500 bp, Homo sapiens
  misc_feature: HEFZJCU01B39AU.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggcccgtgggcgtgcctggtcaggctacttccga

SEQ ID NO: 530451 - DNA, 529 bp, Homo sapiens
  misc_feature: HEFZJCU01C6YQ6.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccggggaaccctggtcaccgtctccccacctccaccg

SEQ ID NO: 530452 - DNA, 516 bp, Homo sapiens
  misc_feature: HEFZJCU01CUP04.22.36.D03.1.454.heavy.3.raw
  modified_base (382)..(382): a, c, t, g, unknown or other
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggggccncgttcatcatctccagagacgattccgaaaacacagtgaatctgcaaatgtacagcctcagcgccgaggacacggccggtctacttctgtgcgaagacctctattttgggccgcgggccgactactgggccgac

SEQ ID NO: 530453 - DNA, 489 bp, Homo sapiens
  misc_feature: HEFZJCU01BQ1HH.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggaggtgggttgcatacattagtagtagtgatagttccatatactacgcagactctgtgaagggccgattcaccatctccagagacagtgccaagaactcactgtatctgcaaatgaaacagccttagagacgacgacacggctggtgtattactgtgcgagagatccg

SEQ ID NO: 530454 - DNA, 537 bp, Homo sapiens
  misc_feature: HEFZJCU01CUZIW.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccgagggagggctggtgtgggtctcacattataatctcgatgggagtaatttagccttacgcggactccgtcaagggtccgatttcaccgtctccagagacaacaccaagaacacactatatctgcagatgacagtctgagacccgaggacgacgctgtagtattactgtgcaaggcagttcgtaggaactagttagtgggttggggggagtttggggtttttttttacgtactacgggatc

SEQ ID NO: 530455 - DNA, 521 bp, Homo sapiens
  misc_feature: HEFZJCU01CW10N.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaagggcccatcggtcttccccctggcaccctcctccaagagcacctctgggggcacgacg

SEQ ID NO: 530456 - DNA, 484 bp, Homo sapiens
  misc_feature: HEFZJCU01EF3G4.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaagggccgattcaccatctccagagacaactccaagaacactcttgtttctaccaatgaacagcctgagaggcgaggacacggcagtgtattactgtgcgagagatcgaca

SEQ ID NO: 530457 - DNA, 492 bp, Homo sapiens
  misc_feature: HEFZJCU01D508Q.17.36.D03.1.454.heavy.3.raw
cgtagactagcacgaccggtgctcgatttagctgcgtcacgatctctcttgggtctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctggggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgttgaagggccgattcaccatctccagagacagtgcaagaactcactgtatctgcaatgaacagccttagagacgacgacacggctgtgtattacttgtgcgaggagatccgcgtg

SEQ ID NO: 530458 - DNA, 552 bp, Homo sapiens
  misc_feature: HEFZJCU01DHGD1.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccgtcgggggcccgggaacccgtcggtcaccgtctcctcagcctccacccgaacggcccatcggttcctttcccccgtcggccacccctccctaccaagacg

SEQ ID NO: 530459 - DNA, 495 bp, Homo sapiens
  misc_feature: HEFZJCU01D99Q7.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggccgccctgctccaggacgcacctccgagagcacagccggcccgtgggctgcctggtcaaggactacttccgtatctctcg

SEQ ID NO: 530460 - DNA, 535 bp, Homo sapiens
  misc_feature: HEFZJCU01AOGQZ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgcttcctttttacacctcccttgactttctggggccagtacggaccccggtaccg

SEQ ID NO: 530461 - DNA, 528 bp, Homo sapiens
  misc_feature: HEFZJCU01D8JVJ.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccaggggaaggggctgatggtgggtctcacgtattgatgttgatgggagttacagtgaccacgcggtactctgtgaagggccgattcaccgtctccagagaaaacgccaagaacacggtgtatctgcaaatgactggcctgagagccgaggacacggcagtttattactgtgcaagagcttgtggtcgactgtcgacctggactggtacttcgatcgtgtggggccggtggcaccgtc

SEQ ID NO: 530462 - DNA, 539 bp, Homo sapiens
  misc_feature: HEFZJCU01BT3FT.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctccggatttgttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagcccgaggaccacggctgtatattattgtgtgagattagacgcacttactttgactacgtggggccacggggaaccctgggtcacccgtct

SEQ ID NO: 530463 - DNA, 502 bp, Homo sapiens
  misc_feature: HEFZJCU01E0D4J.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagagggagctattatctggaaccccgagt

SEQ ID NO: 530464 - DNA, 469 bp, Homo sapiens
  misc_feature: HEFZJCU01BU3ZC.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgaccccctggggcccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 530465 - DNA, 523 bp, Homo sapiens; identical to SEQ ID NO: 472194
  misc_feature: HEFZJCU01E1BT8.13.76.G10.1.454.heavy.3.raw

SEQ ID NO: 530466 - DNA, 396 bp, Homo sapiens; identical to SEQ ID NO: 444469
  misc_feature: HEFZJCU01A5LVF.47.46.E02.1.454.heavy.3.raw

SEQ ID NO: 530467 - DNA, 505 bp, Homo sapiens
  misc_feature: HEFZJCU01COSPV.19.67.G01.1.454.heavy.3.raw
  modified_base (483)..(483): a, c, t, g, unknown or other
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccaggacacggccgtctattattgtgtgagagttttangggcatggctggtggacagatc

SEQ ID NO: 530468 - DNA, 513 bp, Homo sapiens; identical to SEQ ID NO: 464160
  misc_feature: HEFZJCU01AY3L1.3.34.D01.1.454.heavy.3.raw

SEQ ID NO: 530469 - DNA, 485 bp, Homo sapiens
  misc_feature: HEFZJCU01EO5S9.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcagacagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacgacgggtgtatattactgtggaagacggcccccatacg

SEQ ID NO: 530470 - DNA, 510 bp, Homo sapiens
  misc_feature: HEFZJCU01DA08G.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggatccctggctggcacctgtatccgaccgttggagtcagggaactctggtcaccgtctcctcagcctccaccaacgggcccatcggtcttccccctggccgccctcgctccaggagcacctccgagagcacagcggccc

SEQ ID NO: 530471 - DNA, 518 bp, Homo sapiens
  misc_feature: HEFZJCU01CER38.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaagggctggagtgggtaggttcattagagccatggcttatgctgggacaacagaatacgccgcgtctggtgaaaggcagattcatcatctcaagagatgattcaacggcatcgcctatcctgcagatagaacagcctgaagaccgaaggacacacgccgtctattactgtgttagggtagttttacgtattttggagtggatagttta

SEQ ID NO: 530472 - DNA, 514 bp, Homo sapiens
  misc_feature: HEFZJCU01BRWCJ.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacgacggccgtctattactgtgcgacgagaagcggcggacaggaggttcgcttacgtaggttcgaggctccc

SEQ ID NO: 530473 - DNA, 519 bp, Homo sapiens
  misc_feature: HEFZJCU01EBTOS.51.9.A09.1.454.heavy.3.raw
cgatcgtatacacgaccggtgctcgatttagcgagacgcgcagggggccttagccctggattccaaggcatttccacttggtgatcagcactgaacatagaggactcaccatggagttgggactgtgctgggttttccttgttgctattttagaaggtgtccagtgtgaggtgcggctggtggagtctgggggaggcttggtacagcctggggggtccctgacactctcctgtgcagcctctggattccccttcagaacttatgaaatgaactgggtccgacaggctccagggaaggggctggagtgggtttcacacattagtagtggtggaagtaccatattctacgcagactttgtgcagggccgattcaccatctccagagacgacgccaagaattcactgtatctgaaaatgaacagcctgagagccgacgacacggctgtttattactgtgcgagagattactatcatagtagttggttttttccctactactccggtatggacgtcgtggggc

SEQ ID NO: 530474 - DNA, 375 bp, Homo sapiens; identical to SEQ ID NO: 454393
  misc_feature: HEFZJCU01DFXKE.13.42.D09.1.454.heavy.3.raw

SEQ ID NO: 530475 - DNA, 487 bp, Homo sapiens
  misc_feature: HEFZJCU01BOA7O.10.55.E11.1.454.heavy.3.raw
  modified_base (481)..(481): a, c, t, g, unknown or other
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaggtgctanaatcac

SEQ ID NO: 530476 - DNA, 483 bp, Homo sapiens; identical to SEQ ID NO: 449188
  misc_feature: HEFZJCU01A4H4C.7.10.A10.1.454.heavy.3.raw

SEQ ID NO: 530477 - DNA, 556 bp, Homo sapiens
  misc_feature: HEFZJCU01AUL1A.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggtcttgttcgtgggggcccgagggggacccgtgggtcacgttccgttcctccccctaacgccctccaacccgaaggggcccctagtccggtcctttcccccgtgggtccg

SEQ ID NO: 530478 - DNA, 503 bp, Homo sapiens
  misc_feature: HEFZJCU01C32HF.53.41.D08.1.454.heavy.3.raw
cgcgtatacacacgaccggtgctcgatttagtcacgcgagaaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtcccccggtacgtttgtacg

SEQ ID NO: 530479 - DNA, 521 bp, Homo sapiens
  misc_feature: HEFZJCU01CYDXC.16.2.A02.1.454.heavy.3.raw
  modified_base (485)..(485): a, c, t, g, unknown or other
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaaggggctggagtgggtcgcatccattagtggtggtaataattacatatactacggagacctcaatgaagggccgcttcaccatctccagagacaacgccgaaaactcactgtatctgcagatgaacagcctgagagccgaagacaacggctggtgtatttactgtgcgagaggtcttaactntagttcggggagttaatataacgacgtatttacgta

SEQ ID NO: 530480 - DNA, 549 bp, Homo sapiens
  misc_feature: HEFZJCU01CVFQ1.48.40.D07.1.454.heavy.3.raw
  modified_base (547)..(547): a, c, t, g, unknown or other
agtatacatacacgaccggtgctcgatttagtgatagagcgtaacaacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtattttgcagatgagaaatctgagaggcgaggacaccgcgctttattattgtacaacgtgttttacttttctaatggtggctcttacgaacgacatgactattggggtcggggaaccctggtcaccgtctcctcagcctcctaccaagggcccatcggtcttccccctggccaccctcctccaagagcacctntc

SEQ ID NO: 530481 - DNA, 545 bp, Homo sapiens
  misc_feature: HEFZJCU01C11ZV.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggcttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatcctgcaattgaccagcctgagcgccgaggacacggccatcgtattactacgtactaaatcgtcggggtcggccggcggcccggtaccgtccggattgggttttgagttttcgtcggggtccgaagggacg

SEQ ID NO: 530482 - DNA, 548 bp, Homo sapiens
  misc_feature: HEFZJCU01EZ1UE.48.12.B01.1.454.heavy.3.raw
agtatacatacacgaccggtgctcgatttagtagtgtagattccgcgggcacgaccggtgctcgatttagacagtatatatccgcgggcacgaccggtgctcgatttagacgcgatcgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttagttattgtacttctgaggtgacgggaaccgctggctattggggccagggaaccctggtcgccgtctcctcagcctccaccaagggcccatcggtcttcccctggccgccctgcctcctacggacgcacccgtccgagacgcacg

SEQ ID NO: 530483 - DNA, 527 bp, Homo sapiens
  misc_feature: HEFZJCU01CHX5M.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccacgtaggtttgacttacgtggggccaggggaagctttggtccaccgtctcctcacgcct

SEQ ID NO: 530484 - DNA, 517 bp, Homo sapiens
  misc_feature: HEFZJCU01BV496.48.59.F04.1.454.heavy.3.raw
agtatacatacacgaccggtgctcgatttagtacacacacttagggattggggatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcgttttgtatgcctttgtatattgtggggtcgaagggacgaatggtcaccggtctcttcacgcctaccaacccg

SEQ ID NO: 530485 - DNA, 480 bp, Homo sapiens
  misc_feature: HEFZJCU01EDC7J.4.37.D04.1.454.heavy.3.raw
  modified_base (424)..(424): a, c, t, g, unknown or other
  modified_base (473)..(473): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctanatggacctgagcggcctgacatctgacgacacgggcctatatttctgtncggaggg

SEQ ID NO: 530486 - DNA, 519 bp, Homo sapiens
  misc_feature: HEFZJCU01A4KRX.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtttctggggccaggggacctggtcatcgtctccccagcctccaccaggcccatcggtcttcccctggcg

SEQ ID NO: 530487 - DNA, 538 bp, Homo sapiens
  misc_feature: HEFZJCU01B1UFX.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattcccaagaacactctatttcttcaaatggacagcctgaaagacgaagacacgggcgtgtatttttgtgtgaaagatacgaagtctatgatacccaatttgggaggggctttcatgtctggggccaagggacgctggtcaccgtctcttcagctccaccaagggcccatcggtcttcccctggccacctccctccaacgagcacctctgggggcacagcc

SEQ ID NO: 530488 - DNA, 533 bp, Homo sapiens
  misc_feature: HEFZJCU01CZLU1.16.87.H10.1.454.heavy.3.raw
tgtactactccacgaccggtgctcgatttagcagtactgcgttgggtttgggggaggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagtttggggttttttttacgttacgttac

SEQ ID NO: 530489 - DNA, 508 bp, Homo sapiens
  misc_feature: HEFZJCU01EPXLB.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagcaccggcagttagtcacccatactactttgactactgggg

SEQ ID NO: 530490 - DNA, 534 bp, Homo sapiens
  misc_feature: HEFZJCU01D3AL0.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgcttcctttttacacctcccttgtactttctggggccatggaaccccggtccg

SEQ ID NO: 530491 - DNA, 501 bp, Homo sapiens
  misc_feature: HEFZJCU01EV9HY.40.81.H04.1.454.heavy.3.raw
  modified_base (491)..(491): a, c, t, g, unknown or other
tctagcgactcacgaccggtgctcgatttagtagtgtagattcgcggggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccttgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactggacctacgtgacgacacggcatgattactgtggagagtcgtggtggctacgcggtcgtgaacncgtggggccg

SEQ ID NO: 530492 - DNA, 502 bp, Homo sapiens
  misc_feature: HEFZJCU01D6X3C.7.85.H08.1.454.heavy.3.raw
cgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactggtccgccaggctccagggaaggggctgcagtgggtttcacacattaatactggaagtaggaccataacttacacagactctgtgaagggccgattcaccacctccagagacgacgccaagaactcactgtctctgcaatgaacagcctgagagtcgaggacacggctgtgtattactgtgcgagagagtccggagggggacgtagtcgacc

SEQ ID NO: 530493 - DNA, 528 bp, Homo sapiens
  misc_feature: HEFZJCU01AUNR9.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgacgttggagtcagggaactctggtcaccgtctcctcagcctccaccaacgggcccatcggttccttccccctggccgccctcgctccaggagctaccctccgagacgcacagccggcccgtcgggccgtcg

SEQ ID NO: 530494 - DNA, 525 bp, Homo sapiens
  misc_feature: HEFZJCU01EAQLQ.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatctagtatctaggaaatgaacaatctgagagtcgacgatacggctgtctactcattgttgttttcgattcgtcctttccggtccgcgggtacttccgtcggggaccgacgggtacccg

SEQ ID NO: 530495 - DNA, 417 bp, Homo sapiens
  misc_feature: HEFZJCU01CO613.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacacccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 530496 - DNA, 498 bp, Homo sapiens
  misc_feature: HEFZJCU01DPUC5.48.1.A01.1.454.heavy.3.raw
agtatacatacacgaccggtgctcgatttagacgtctcatcagggaaagggggctctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcaggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgaccaagcactcactgtatctccaaatgaacagcctagagagccgacgacacggctgtgtattactgtgcgagtacgttgggaggagagt

SEQ ID NO: 530497 - DNA, 532 bp, Homo sapiens
  misc_feature: HEFZJCU01AUY2V.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacggggcgtttattactgtgcgaggaggggacggactacggtgactacgtgggggttcgaccccgtggggccagggaaccctggtcaccgtctcctcagcctccaaccg

SEQ ID NO: 530498 - DNA, 519 bp, Homo sapiens
  misc_feature: HEFZJCU01AJE4T.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaacggcccatcggtccttcccctggccaccctcctccaagagcacctcgtgggggcacagcgcctgggctgcctgtcaacggactacttccagacgtatca

SEQ ID NO: 530499 - DNA, 519 bp, Homo sapiens
  misc_feature: HEFZJCU01DUX8I.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttggatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaatgaacaacctgagagccgacgacacggtccgtttattactgtgcgagagattcgagtggttcggggacctccacctggtctacttcgatctctc

SEQ ID NO: 530500 - DNA, 520 bp, Homo sapiens
  misc_feature: HEFZJCU01CGBKF.40.37.D04.1.454.heavy.3.raw
tctagcgactcacgaccggtgctcgatttagtagcatactgttgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcgaggaagtgggagctgggagcctcaatcgtggggacc

SEQ ID NO: 530501 - DNA, 492 bp, Homo sapiens
  misc_feature: HEFZJCU01AUJW3.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctggagagctgagacacggctgtgtattactgtgcgaaagatttctata

SEQ ID NO: 530502 - DNA, 499 bp, Homo sapiens
  misc_feature: HEFZJCU01ES60R.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaagggctggagtgggtctcatccattagtagtaatagtgcctacagatactacgcagactcactgaaggccgactcaccatctccagagacaacgccaagaactcactgtatctgcaaatgaacagcctgagagccgaggacacggctgtgtattactgtgcgagaggagctattatctcggaaccccgat

SEQ ID NO: 530503 - DNA, 499 bp, Homo sapiens; identical to SEQ ID NO: 447792
  misc_feature: HEFZJCU01B7ZG8.17.10.A10.1.454.heavy.3.raw

SEQ ID NO: 530504 - DNA, 493 bp, Homo sapiens
  misc_feature: HEFZJCU01CCXZF.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaaagataatcgcggtgta

SEQ ID NO: 530505 - DNA, 360 bp, Homo sapiens
  misc_feature: HEFZJCU01A7IRO.3.67.G01.1.454.heavy.3.raw
agacgcactccacgaccggtgctcgatttagagtatacatattgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttccccctggcgccctgctccaggagcacctccgagagcacagcggcctggctgcctggtcaaggactacttccgagtgcgtct

SEQ ID NO: 530506 - DNA, 521 bp, Homo sapiens
  misc_feature: HEFZJCU01BRMZF.13.37.D04.1.454.heavy.3.raw
  modified_base (516)..(516): a, c, t, g, unknown or other
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagacacgctatatctgcagatgaacagcctgggagccggaggaccacggccgttttatccgactggtgacgaaagattactttagtaattcgattgggtancgtgt

SEQ ID NO: 530507 - DNA, 526 bp, Homo sapiens
  misc_feature: HEFZJCU01DYBDZ.13.76.G10.1.454.heavy.3.raw
  modified_base (498)..(498): a, c, t, g, unknown or other
tcacgtactacacgaccggtgctcgatttagtcactcatacaggggggagaggagcccagcactgggattccgaggtgtttccattcggtgatcagcactgaacacagaggactcaccatggagttttggttgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttacctacgctanggacgtcgtcggggccgacgggaccacc

SEQ ID NO: 530508 - DNA, 498 bp, Homo sapiens
  misc_feature: HEFZJCU01CBESJ.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgacagtatctgcaaatgaacagcctgagagctgaggacacggctgtgtatttactgtgggagagagtgggaggtcgatattggta

SEQ ID NO: 530509 - DNA, 495 bp, Homo sapiens
  misc_feature: HEFZJCU01C20IJ.49.83.H06.1.454.heavy.3.raw
agtcgagagacacgaccggtgctcgatttagatcacgtgcgtcgcggggagctctcagagaggtgccttagccctggattccaaggcatttccacttggtgatcagcactgaacacagaggactcaccatggaattggggctgtgctggttttccttgttgctattttagaaggtgtccactgtgacgtgcagctggtggagtctgggggagccttggttcagccttgggagggtccctgagactctcctgtgcagcctctggattcagcttcagtagttatgagatgaactgggtccgccaggctccagggaagggactggagtgggtttcatacattagtcgggagagtcaacaccgtattctaacacagactctgtgaggggccgattcaccatctccagagacaacgccaaagaactcactgtatctccaaattcgaaacagcctgagagtcgaggacacggctgtctattactgtgcgaggagatcccaa

SEQ ID NO: 530510 - DNA, 549 bp, Homo sapiens
  misc_feature: HEFZJCU01DK2SH.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcatcaccgacactgggaaccccacctatgcccaggccttcacagggcggtttgtcttctccatggatacctctgtcgggacggcttatctgcagataaccaaccttcaacctgacgacactgtcccgtttatttttgtacgtagagcgtctctgttcaggtgaattgactactggggccgagggaacccgtggtcctaccggtcctcccttcaacgcctccgacccgtaaacc

SEQ ID NO: 530511 - DNA, 499 bp, Homo sapiens
  misc_feature: HEFZJCU01CYGKO.53.26.C04.1.454.heavy.3.raw
cgcgtatacacacgaccggtgctcgatttagtctagcgactttgggtttgggggcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgaacatctgacgacacggccgtttattattgttgtggagagaggacccgattggaccctggta

SEQ ID NO: 530512 - DNA, 485 bp, Homo sapiens
  misc_feature: HEFZJCU01CRYJC.49.28.C06.1.454.heavy.3.raw
agtcgagagacacgaccggtgctcgatttagagctcacgtattgggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcacccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaa

SEQ ID NO: 530513 - DNA, 508 bp, Homo sapiens
  misc_feature: HEFZJCU01C7U5R.48.55.E11.1.454.heavy.3.raw
  modified_base (493)..(493): a, c, t, g, unknown or other
agtatacatacacgaccggtgctcgatttagcactcgcacgttgggtttggggctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttacncgaccgtcgggaggt

SEQ ID NO: 530514 - DNA, 506 bp, Homo sapiens
  misc_feature: HEFZJCU01EX3F9.19.49.E05.1.454.heavy.3.raw
tactctcgtgcacgaccggtgctcgatttagagcgactagcaacacacaaaggggagctctgggagaagagccccagccccagaattcccaggagtttccattcggtgatcaacactgaacacagaggactcaccatggagtttgggctgagctgggttttccttgttgctattataaaaggtgtccagtgtcaggtgcagctggtggagtctgggggaggcttggtcaagcctggagggtccctgagactctcctgtgcagcctctggattcaccttcagtgactactacatgagctggatcccgccaggctccagggaaggggctggagtgggtttcatatattagtagtagtggtagtaccatatactacgcagactctgtgaagggccgattcaccatctccagggacaacgccaagaactcactatatctgcaaatgaacagcctgagagccgaggacacggccgtgcattactgcgcgagaattcaaggccgaaggggcg

SEQ ID NO: 530515 - DNA, 502 bp, Homo sapiens
  misc_feature: HEFZJCU01DHVUS.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaaagccaagaactccctgttctgcaaatggacaatttgagagaggaagacacggccttatatttctgtgcgagagccctcggcagaagtctggactactactattatggtatggacgtctggggccaaggaccacggtcatcgtctcctcagcctccaccaagggcccatcggtcttcccctggcaccctcctccaagagcacctctgggggcacagcggcctgggctgcctggtcaaggactacttcctacgtcgtat

SEQ ID NO: 530516 - DNA, 523 bp, Homo sapiens
  misc_feature: HEFZJCU01DW90B.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaaatagacagcctgacgaccagacgacacggctgtctattattgcgcgagagagacacacgaacctactggccaatactatgggggcttgttctggggccaggggaccctggtcatcgtctccccagcctccaccacgggccatcggtcttcccctggccg

SEQ ID NO: 530517 - DNA, 521 bp, Homo sapiens
  misc_feature: HEFZJCU01DFKS7.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttatttaccg

SEQ ID NO: 530518 - DNA, 527 bp, Homo sapiens
  misc_feature: HEFZJCU01AZXJZ.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggcctggagtggatctcacttatttatagtggtggtaccacatactacacagactccgtgaagggccgattcaccatctcagaagacaattccaggaacacattgtatcttcaaatgaataacctgagaagccgaggacacggccatgtattactgtgtggggcatttacttgacccctggggccggggaacccgtggtcaccgtctcccca

SEQ ID NO: 530519 - DNA, 407 bp, Homo sapiens
  misc_feature: HEFZJCU01EF998.3.17.B06.1.454.heavy.3.raw
  modified_base (355)..(355): a, c, t, g, unknown or other
agacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtgggtctactggggccagggaaccctggtcaccgtctcctcagcctccaccaagggcccatcggtcttccccctggcgccctgctccaggagcacctccganaggcacagcggcccgtgggctgcctggtcaaggactacttccgagtgcgtct

SEQ ID NO: 530520 - DNA, 482 bp, Homo sapiens
  misc_feature: HEFZJCU01CCVJV.51.38.D05.1.454.heavy.3.raw
  modified_base (358)..(358): a, c, t, g, unknown or other
cgatcgtatacacgaccggtgctcgatttagtatctgatagtgggtttgggctcaactctcttgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttacngtgcgccaggaagcagtggctggccacatcatgcttttgatatctggagccaagggacaatggtcatcgtctctcgcctccacaaggcccatcggtcttcccctggcaccctcctccaagagca

SEQ ID NO: 530521 - DNA, 520 bp, Homo sapiens
  misc_feature: HEFZJCU01EUKRS.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctcccgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttatagtccctactttcgactacgtgggccagggactctggtcaccgtctccgcagcctccaccaacgggcccatcc

SEQ ID NO: 530522 - DNA, 505 bp, Homo sapiens
  misc_feature: HEFZJCU01DL6I5.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattatgtgcgcgacatgactacgctcaattctggggccaggggacg

SEQ ID NO: 530523 - DNA, 513 bp, Homo sapiens
  misc_feature: HEFZJCU01AZH1W.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaacctcctccataaacacagcctacatggagttgaggagcctgacatctgacgacacgggccgtctattactgtgcgagacgtcccacgatccggtgagcctacgggcaggccggtcctttgacctttcgtc

SEQ ID NO: 530524 - DNA, 505 bp, Homo sapiens
  misc_feature: HEFZJCU01B2Z0Y.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgactccggtgagcctacggcagcggcctttgacttgtc

SEQ ID NO: 530525 - DNA, 506 bp, Homo sapiens; identical to SEQ ID NO: 448333
  misc_feature: HEFZJCU01BCOFC.10.88.H11.1.454.heavy.3.raw

SEQ ID NO: 530526 - DNA, 510 bp, Homo sapiens
  misc_feature: HEFZJCU01BGNLZ.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagatggggcccacgaacgttacgtacgcctatggaccgtcgt

SEQ ID NO: 530527 - DNA, 528 bp, Homo sapiens
  misc_feature: HEFZJCU01CDZYW.53.17.B06.1.454.heavy.3.raw
cgcgtatacacacgaccggtgctcgatttagtcgatagtgaagggggctctgggagaggagcccagcactagaagtcggcggtttttccattcggtgatcagcactgaacacagaggactcaccatggactgttaagaggtgtgtcgagcactgggtccgccaggctccaggcaaggggctgaagtgactgccacttaacatcagatgatcgaatcaataggttttatgcggactcggtgaggggccgattcaccgtctccggagacaattccaagaatacgagataggtgcaaatgaagaccctgggacttgaagacacgggtgcgtcttcctgtgcgactgtgtcccaacgttgtattctttgagtggacgtctcgagaacaagggaccacggtcatcgtctcctccgatgagactgaccactctgggggcctttgatttccgccactgcctgtggaatttccgcactagtggagcctccaccaacgggcccatccggtcttccccgtgccaccctcctccagacg

SEQ ID NO: 530528 - DNA, 485 bp, Homo sapiens; identical to SEQ ID NO: 456831
  misc_feature: HEFZJCU01ARFGJ.19.13.B02.1.454.heavy.3.raw

SEQ ID NO: 530529 - DNA, 497 bp, Homo sapiens
  misc_feature: HEFZJCU01EF9VH.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctggagatatgacgacgacggccgtgtattattgtgcgagagtggagtggcaggtggatatcgacaaattactactta

SEQ ID NO: 530530 - DNA, 489 bp, Homo sapiens
  misc_feature: HEFZJCU01CKM9N.53.15.B04.1.454.heavy.3.raw
  modified_base (353)..(353): a, c, t, g, unknown or other
  modified_base (471)..(471): a, c, t, g, unknown or other
cgcgtatacacacgaccggtgctcgatttagacagtatatatccgcgggggctctgggagaggagcccagcactagaagtcggcggtgtttccattcggtgatcagcactgaacacagaggactcagcatggagtttgggctgagctgggttttcctcgttgctcttttaagaggtgtccagtgtcaggtgcaactggtggagtctgggggagcgtggtccagcctgggaagtcactgcgactctcctgtgcagcctctggattcagcttcagctcgtatgcgatgcactgggtccgccaggctccaggcaaggggctggagtgggtggcggttatttcacatgatggaagtnaggaatattatgcagactccgtgaggggccgattcaccatctcccgagacaattccaagaacacagtggatctgcaaatgagtagcatgagagttggggacacgggcggtgtattacngtcgcgaaggtcttggct

SEQ ID NO: 530531 - DNA, 521 bp, Homo sapiens
  misc_feature: HEFZJCU01E0DKA.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaactacccgtcgcctggttatttaccg

SEQ ID NO: 530532 - DNA, 534 bp, Homo sapiens
  misc_feature: HEFZJCU01DG9AA.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttgggggtttcgaccccgtggggcccagggaaccctggtcaccgtctcctcagcctccaccaaggcccatccggtcttccccctggcacccctcctccaacgagcacctcgtggggggcacgagcc

SEQ ID NO: 530533 - DNA, 501 bp, Homo sapiens
  misc_feature: HEFZJCU01DLWZU.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaaccattaccagggacacatccgcgaacacagcctacatggagctgagcagcctgacatctgaagacacggctgtgtattactgttcgagacgggctagtctgggatctagttatagtgactcgtcgttcgtgggg

SEQ ID NO: 530534 - DNA, 545 bp, Homo sapiens
  misc_feature: HEFZJCU01D1AHF.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggaggtggatctcacttatttatagtggtggtaccacatactacacagactccgtgaagggccgattcaaccatctcagaagacaattccaggaacacattgtatcttcaaatgaataacctgagagccgaggacacggccatgtattacttgtgtgggggcatttactttgtacccctgggggcccgggggtaacccgtggtcaccggttctccccacccctccaacccg

SEQ ID NO: 530535 - DNA, 508 bp, Homo sapiens
  misc_feature: HEFZJCU01EWZKZ.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccgaatgaccagggacaagtccaccaacacagcctacatggaactaaggggactgacatctgacgacacggccatgtattattgtgcgagagaaatgttaggtactgctttgggtcctggggcccgggaacccgggtc

SEQ ID NO: 530536 - DNA, 501 bp, Homo sapiens
  misc_feature: HEFZJCU01DXU7O.4.75.G09.1.454.heavy.3.raw
  modified_base (418)..(418): a, c, t, g, unknown or other
  modified_base (487)..(487): a, c, t, g, unknown or other
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctccgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtncacagagatacgggcagcacgtggttggggtctacgtggggccagggaaccctggtccaccgtctcctnacgcctccaccaac

SEQ ID NO: 530537 - DNA, 529 bp, Homo sapiens
  misc_feature: HEFZJCU01DGPN3.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggcccggggaaccctggtcaccgtcctccccaccctccaaccg

SEQ ID NO: 530538 - DNA, 504 bp, Homo sapiens
  misc_feature: HEFZJCU01C7RRR.53.81.H04.1.454.heavy.3.raw
cgcgtatacacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggagcgtggtccagcctggggggtccctgagactctcctgtgcagcctctggattcaccttcagcacctatcctatgcactgggtccgccaggctccaggcaagggactggagtggggtggcagttatatcattttgatggaagcactacatactacgcaaactccgtgaagggccgattcaccatcctccagagacgattccaggaacactctgtttctccaatgaacagcctgagagctggaggacgacggctctttattactgtgcgagagattctgggatacagcctattta

SEQ ID NO: 530539 - DNA, 383 bp, Homo sapiens; identical to SEQ ID NO: 446603
  misc_feature: HEFZJCU01A1II6.11.61.F06.1.454.heavy.3.raw

SEQ ID NO: 530540 - DNA, 506 bp, Homo sapiens; identical to SEQ ID NO: 471304
  misc_feature: HEFZJCU01CS0RZ.18.50.E06.1.454.heavy.3.raw

SEQ ID NO: 530541 - DNA, 522 bp, Homo sapiens
  misc_feature: HEFZJCU01B9OPZ.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaaccacaatgtatttggagcgtgaacagcctaagtcctgaggacacgggcgtatactactgtacgaaggaggggggaaccgaggcgggagttccaagtactcctttgacgtcgtc

SEQ ID NO: 530542 - DNA, 538 bp, Homo sapiens; identical to SEQ ID NO: 519113
  misc_feature: HEFZJCU01D7HOP.17.28.C06.1.454.heavy.3.raw

SEQ ID NO: 530543 - DNA, 549 bp, Homo sapiens
  misc_feature: HEFZJCU01BRLUE.49.86.H09.1.454.heavy.3.raw
agtcgagagacacgaccggtgctcgatttagtgctatagacttgggtttgggtatagacttgggtttggggggaagaggaagactgacggtccccccaggagttcaggtgctgggcacggtgggcaacttatgagcccgaaaggacatggccacggggtgggtagggacatagggccagatgccagcctgaggtggagcctcaggtcacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggtttggatgactcttacttctacttctacgttatggacctctggggccaagggaccacggtcaccgtctcctcagcctccaccaagggcccatcggtcttcccctggcaccctcctccaagagcacctctgggggcacg

SEQ ID NO: 530544 - DNA, 515 bp, Homo sapiens
  misc_feature: HEFZJCU01EG2MU.48.2.A02.1.454.heavy.3.raw
agtatacatacacgaccggtgctcgatttagactcatctacaggggctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctggggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgacaaatgagcagcctgagagccggaggacacggctactatattactgtacgagagtatttcacgcccctacccaaacgtaggtaaattaatta

SEQ ID NO: 530545 - DNA, 540 bp, Homo sapiens
  misc_feature: HEFZJCU01A050W.17.33.C11.1.454.heavy.3.raw
  modified_base (363)..(363): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccnggtggtccttacaatgaccaatatggaccctgtggacacagccacatattactgttcacgctctatgggttcggggagttattagtccctaacgtttgacttacgtcgggggccaggggaactcgtggtccacccgtcttcccgcacgccctcccaccgaacggggccccaagttcc

SEQ ID NO: 530546 - DNA, 545 bp, Homo sapiens
  misc_feature: HEFZJCU01DZFNH.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagttggttctagtggaagtacattcgacgccgtctccgtgaagggccggttctccatctccagagacaattccaagaacactctatttcttctaaatggacagcctgaaagacgaagacacgggctgtatttttgtgtgaaagatacgaagtctatgatacccaatttgggaggggcctttcatgtctgggccaagggacgcgtggtcacccgtctcttctagcctccaccaacgggcccatcggtccttcccctcggcaccctcctccaagagcacctctggggggcacgagcc

SEQ ID NO: 530547 - DNA, 513 bp, Homo sapiens
  misc_feature: HEFZJCU01APVN5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggagtgggcgaaccctaacactggtgtcacagtgtcttcacccatcctccgggacagacttaccatgaccacgaactcctccataaacacagcctacatggagttgaggagcctgacatctgaccgacacggccgtctattactggtgcgagacgtcccacgactccgggtgacgcctacgggcagcggccttttgacttcgtc

SEQ ID NO: 530548 - DNA, 500 bp, Homo sapiens; identical to SEQ ID NO: 446033
  misc_feature: HEFZJCU01EZ0LF.11.27.C05.1.454.heavy.3.raw

SEQ ID NO: 530549 - DNA, 512 bp, Homo sapiens
  misc_feature: HEFZJCU01DIZBR.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactactgggccagggaactcgtgtcaccgtctccgcagcctccacaagggccc

SEQ ID NO: 530550 - DNA, 514 bp, Homo sapiens
  misc_feature: HEFZJCU01B7QXV.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatcccacgagcaacagcctacatggacctggaggagcctgagatttgacgacacggccaatatattactgtgcgagagattgggccgacggaaccttgactactgggccagggaaccctggtcaccggt

SEQ ID NO: 530551 - DNA, 543 bp, Homo sapiens
  misc_feature: HEFZJCU01ARM16.49.10.A10.1.454.heavy.3.raw
agtcgagagacacgaccggtgctcgatttagcgtcgatctcaggggagctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggctggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaatgaatggcctcgttttgcggacacggctgtttattattgtgcgacgagggggcccccgttcctacggagcgagtcatactactttacgtacctaactcggggaccgagggtaaccg

SEQ ID NO: 530552 - DNA, 536 bp, Homo sapiens
  misc_feature: HEFZJCU01D6JRS.10.53.E09.1.454.heavy.3.raw
catagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcgggccgattcaccatctccaaagaacaatttagaagaacacgactgtttctgcaatagaacagcctgagagctaggaggaacgacgggcctgtgtaattacttgttcggttttggtttcttggaccttcggttcggggggtaactaccgtttac

SEQ ID NO: 530553 - DNA, 489 bp, Homo sapiens
  misc_feature: HEFZJCU01E1R9I.49.79.H02.1.454.heavy.3.raw
agtcgagagacacgaccggtgctcgatttagtgtcacacgaagggaaaggggtctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtggggtggctatttatagtcatatgatggaagcaagatatactatgtagactccgtgaagggccgattcatcatctccagagacaactccgagaacacgctgtatctgcaaatgaactaggctgagagctagaagacacgggcttttagtattactggtgcgtaac

SEQ ID NO: 530554 - DNA, 524 bp, Homo sapiens
  misc_feature: HEFZJCU01C4MIE.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagcgatgacacggccgtgtattactgtgcgagagatggggcccaacggaacgttacctacgctatggacgtcgtgggggcccaagggaccg

SEQ ID NO: 530555 - DNA, 519 bp, Homo sapiens
  misc_feature: HEFZJCU01BJOSN.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccggacgacacggctatctattactgtgcgaaactctacattccgttcatctgaatacgtggggccaggggaacccctgggtccgtcccg

SEQ ID NO: 530556 - DNA, 479 bp, Homo sapiens
  misc_feature: HEFZJCU01D7OFH.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcacccggtctcctcagcctccaccaagggcccatcggtcttccccctggcaccctcctccaagagcacctctgggggcacagcggccctgggctgcctggtcaaggactacttccgagtagtaca

SEQ ID NO: 530557 - DNA, 517 bp, Homo sapiens
  misc_feature: HEFZJCU01CFTKW.48.81.H04.1.454.heavy.3.raw
  modified_base (489)..(489): a, c, t, g, unknown or other
agtatacatacacgaccggtgctcgatttagtagtgtagattcgcggggacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgacgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatnatctactactttgaatcgttggggcccc

SEQ ID NO: 530558 - DNA, 512 bp, Homo sapiens
  misc_feature: HEFZJCU01EY1TM.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccggtgagcctacggcagcggcctttgactttcgtggggccaggggacg

SEQ ID NO: 530559 - DNA, 486 bp, Homo sapiens
  misc_feature: HEFZJCU01B3VO9.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtccttcccctggcgccctgctccaggagcacctccgagagcacagcggtcctgggctgcctgtcaggactacttcctagtacgtga

SEQ ID NO: 530560 - DNA, 506 bp, Homo sapiens
  misc_feature: HEFZJCU01CULFU.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacactggagctgagcagcctgacatctgaagacacggctggtgtattactgttcgagacgggtctagtctgggatctagttatagtgactcgtcgttctggggaccg

SEQ ID NO: 530561 - DNA, 529 bp, Homo sapiens
  misc_feature: HEFZJCU01AIWTR.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccacgtcggtcccttccccgtcggccgcctcgctccgaggacgacgacctcggtcggggcgacgagccggtcc

SEQ ID NO: 530562 - DNA, 504 bp, Homo sapiens
  misc_feature: HEFZJCU01CC5HY.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcgaactctcacactggaagcagagtctatgcggagagattccagggcagagtcaccctgaccacagagacatccacgaccacagtctacatggagctgtgagcctgagacctgacgacacggccctcgattactgtgcgaggccctagtcctacagtgaccactccacgctggtcgactctgggccac

SEQ ID NO: 530563 - DNA, 497 bp, Homo sapiens
  misc_feature: HEFZJCU01BLS6Y.26.78.H01.1.454.heavy.3.raw
  modified_base (399)..(399): a, c, t, g, unknown or other
  modified_base (426)..(426): a, c, t, g, unknown or other
  modified_base (450)..(450): a, c, t, g, unknown or other
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcggtggtccagcctgggaggtccctggagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccaganactaatttgaagaacacgctgtatctnacaatgaaccagcctagagagcgngaaagacgacggcgtgttgttttccgttgtggcgagagagagtgacg

SEQ ID NO: 530564 - DNA, 510 bp, Homo sapiens
  misc_feature: HEFZJCU01DSHJ3.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctcgcagcctcaccaaggccc

SEQ ID NO: 530565 - DNA, 514 bp, Homo sapiens
  misc_feature: HEFZJCU01EJ7X2.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggactcgtgggaccg

SEQ ID NO: 530566 - DNA, 407 bp, Homo sapiens
  misc_feature: HEFZJCU01EZFW7.40.81.H04.1.454.heavy.3.raw
tctagcgactcacgaccggtgctcgatttagtagtgtagattcgcggggacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 530567 - DNA, 506 bp, Homo sapiens
  misc_feature: HEFZJCU01CIZ4R.10.55.E11.1.454.heavy.3.raw
catagtagtgcacgaccggtgctcgatttagcactcgcacgttgggtttgggctcaactctcttgtccaccttggtgttactggacctggagggtcttctgcttgctggctgtagttccaggtgctcactcccaggtgcagctggtgcagtctggggctgagatgaagagtcctggggcctcagtgaaggatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcgttttagaattttgggggccaaggggacaatggtcatcgtctcctctacg

SEQ ID NO: 530568 - DNA, 527 bp, Homo sapiens
  misc_feature: HEFZJCU01DAZNC.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcggggcccaggagtggtgaagccttcggagaccctgtccctcagttgtaatgtgtctggtggctccctaagtaggactacttactactggggctggatccggcagcccccagggaaggggctgggagtggattggggatatctcttatagtgggagtacgaactacaatccgtcctcaagagtcgagtcatcatatccgtagacaggtccagggaacgaattctccctgaaagtgagttctgtgaccgtcgcagacacggctgtctattattgttgcgagacggcaaatatggttcagggagttcgactactggggccagggaaccctggtccacgtctcctcagcctccaccaggacccg

SEQ ID NO: 530569 - DNA, 503 bp, Homo sapiens
  misc_feature: HEFZJCU01DM8F4.10.38.D05.1.454.heavy.3.raw
  modified_base (453)..(453): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaaaccaacatcttgtatcttcacatgacacaatctgagagtcgacganacgggccacctattattgtgcgcgacatgactacgctcaatttcgtgggg

SEQ ID NO: 530570 - DNA, 540 bp, Homo sapiens
  misc_feature: HEFZJCU01DWWKB.51.26.C04.1.454.heavy.3.raw
  modified_base (415)..(415): a, c, t, g, unknown or other
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgtaggggccgattcaccgatctccagagacaattccgggaacacactgtctctgcaaatgaacagcctgagagctgaggacagggctgtttattactgtgtgcgatccgacctcactggtacggggngttaacttcctccgcaacggtatggacgtctgggccaagggaccacggtcaccgtctccttagcctccaccaacgggcccatcggtccttccccctggccaccctcctccaagacgcaccctctc

SEQ ID NO: 530571 - DNA, 518 bp, Homo sapiens
  misc_feature: HEFZJCU01B1J73.48.38.D05.1.454.heavy.3.raw
agtatacatacacgaccggtgctcgatttagtatctgatagttgggtttggggcacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgacctatggtatcaattgggtgcgacaggccccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactgcccgtgttttattgtgcgagatccaggcgaggaggataccggattcttaatatagcgactactaccttacttcggaa

SEQ ID NO: 530572 - DNA, 515 bp, Homo sapiens
  misc_feature: HEFZJCU01CHJYF.13.43.D10.1.454.heavy.3.raw
tcacgtactacacgaccggtgctcgatttagactagcagtaaggggctgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacacgtgccgtgtattactgtgccagcagcagtacctggccactattattttttgacttctc

SEQ ID NO: 530573 - DNA, 503 bp, Homo sapiens
  misc_feature: HEFZJCU01DB5P7.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcgaaccctaccagaggtggcacaaagtatcgacagaactttcagggcagggtcaccatgacctgggacgcgtccatcagcacagtctacatggatctgagcggactagcctctgacgacacggccatgtattactgtggaagagacgttggtggctaccgcggggctgaccacgtggggaccg

SEQ ID NO: 530574 - DNA, 493 bp, Homo sapiens
  misc_feature: HEFZJCU01EZCXZ.11.38.D05.1.454.heavy.3.raw
cgagagataccacgaccggtgctcgatttagtatctgatagttgggtctgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccaggggaaccctggtccaccgtctcctcagcctccaccaaggcccatcggtcttcccctggcaccctcctccaagagcacctcgtgggggcacagcggccctgggctgcctggtcaaggactacttccgtatctctcg

SEQ ID NO: 530575 - DNA, 503 bp, Homo sapiens
  misc_feature: HEFZJCU01CNHW6.9.12.B01.1.454.heavy.3.raw
tgatacgtctcacgaccggtgctcgatttagtagtgtagattccgcggggagctctgggagagtagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaagggctggagtgggtctcagttatttatagcggtggtaacacatactacgcagactccgtgaagggcagattcaccatctccagagacaattccaggaacacgctgtatcttcaaatgaacagacctgagagtcgaggacacggctgtatattactgtgcgagagagtgtgtacgcgttttgattatcgt

SEQ ID NO: 530576 - DNA, 480 bp, Homo sapiens; identical to SEQ ID NO: 445011
  misc_feature: HEFZJCU01D8HLE.22.36.D03.1.454.heavy.3.raw

SEQ ID NO: 530577 - DNA, 541 bp, Homo sapiens
  misc_feature: HEFZJCU01AJ2J4.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctctttttatttatagtagtggtagtacatactccgcagactccgtgaggggccgattccaccatcctccagagacaattccaagaacacgctgtttcttcaaatgaacagcctgagagccgatgacacggccgtgtattactgtgcgagagtagtgggggcccacggaacgttaccgtacgtcctatgggacgttacgtgggggaccgaacggggtaacccg

SEQ ID NO: 530578 - DNA, 550 bp, Homo sapiens
  misc_feature: HEFZJCU01EF448.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctgggagtgggtctctactattactgctagtggtaatcatgcatactatgcagactccgtgaagggccggttcaccttcaccagagacaattccaagaacacgctctatctgcaattgaccagcctgagcgccgaggacacggccagtcgtattactagttacgtaaactacgtcgggtggccgtcggccggtaccgtcggactggttttagtagttttacgtggggtaccgacgggtaacg

SEQ ID NO: 530579 - DNA, 526 bp, Homo sapiens
  misc_feature: HEFZJCU01A8J9C.17.28.C06.1.454.heavy.3.raw
  modified_base (337)..(337): a, c, t, g, unknown or other
  modified_base (367)..(367): a, c, t, g, unknown or other
  modified_base (475)..(475): a, c, t, g, unknown or other
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacgntaaagcaagatggaactgccgagtttacgnggtactctgtgaagggccgtttcaccatctccagagacaacgccaagaattcactgtatctacaactgaacagcctgagagtcgcagacacggccgtgtattactgtncgagatgtggaaaagtaatggctgtgtttattggggccagggagcctggtc

SEQ ID NO: 530580 - DNA, 484 bp, Homo sapiens
  misc_feature: HEFZJCU01CJ4Y9.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcactagcctacatggacctgagcggcctgacatctagacgacacggccgtatactttctggtgcggaggg

SEQ ID NO: 530581 - DNA, 484 bp, Homo sapiens
  misc_feature: HEFZJCU01AUU7T.19.71.G05.1.454.heavy.3.raw
  modified_base (454)..(454): a, c, t, g, unknown or other
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccaagttctccctgcagctgacctctgtgactcccgaggacacgggngtatattactgtggaagacggccccatacg

SEQ ID NO: 530582 - DNA, 514 bp, Homo sapiens
  misc_feature: HEFZJCU01DDWH4.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagccgaacacagtcaacatggagttgcggagcctgcgatctgacgacgcggccgtatattactgtgcgagagtacgtagcggctcgtcctttgactactggggcctgggaactctggtcaccgtct

SEQ ID NO: 530583 - DNA, 375 bp, Homo sapiens
  misc_feature: HEFZJCU01CQ21T.51.76.G10.1.454.heavy.3.raw
  modified_base (256)..(256): a, c, t, g, unknown or other
  modified_base (335)..(335): a, c, t, g, unknown or other
  modified_base (345)..(345): a, c, t, g, unknown or other
cgatcgtatacacgaccggtgctcgatttagtcactcatacaggggtctgggagaggagcccagcactagaagtcggcggtgtttccattcggtgatcagcactgaacacagaggactcaccatggagtttgggctgagctgggttttcctcgttgctctttttaagaggtgtccagtgtcaggtgcagctggtcggagtctgggggagcgtggtccaggcccgggaggtccctgaagctctcctgtgcagcctcnggtattcaccttcaggttgcctagtggcatgctacgtcgggtccgaccaggcctccgaggcaaggggctggaggtgggnggcattttanacgtcaggtatggatgggctaaaggttaaa

SEQ ID NO: 530584 - DNA, 510 bp, Homo sapiens
  misc_feature: HEFZJCU01CDWZ0.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcaacagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacgatcagccctaacagtggtggcacaaactatgcacagaggtttcagggcagggtcaccatgaccagggacacgtccatcagtacagcctacatggagctgagcagtctgagacctgacgacacggccgtgtattattggtgcggttagttacggacgtattacgtacggttttgatttggtctaaccg

SEQ ID NO: 530585 - DNA, 513 bp, Homo sapiens
  misc_feature: HEFZJCU01B0ZMW.51.61.F06.1.454.heavy.3.raw
cgatcgtatacacgaccggtgctcgatttagctacgctctaagggaaaggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtacagccagggcggtccctgagactctcctgtacagcctctggattcacctttggtgattatgctatgagctgggtccgccaggctccagggaaggggctggagtgggtaggtttctttagaggcaaagcttatggtgggacaacagaatacgccgcgtctgtgataggccgattcacatctcaagagatgattaccaaaagcatcgcctatctgcacatgagcagcctgaaaaccgaggacacagccgtgtatttctgtactagagtcttcttatattactatgatacg

SEQ ID NO: 530586 - DNA, 550 bp, Homo sapiens
  misc_feature: HEFZJCU01EVTUM.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgaccgacactgccgttttattttgtacgagagcgtcgtctgtcagtggaattgactacgtggggtccagggaacccgtggtccaccggtcctcctccacggccctaccctacccaaacgggg

SEQ ID NO: 530587 - DNA, 527 bp, Homo sapiens
  misc_feature: HEFZJCU01DRO60.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaaatgaacagcctgagagccgatgacacggccgtgtattactgtgcgagagatggggcccacgaacgttactacgctatggacgtctggggccgaagggacc

SEQ ID NO: 530588 - DNA, 519 bp, Homo sapiens
  misc_feature: HEFZJCU01AUX9W.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatacttactgtgcgagacatgacttcggtgacccctggggccaggggaaccctggtcaccgtctcctc

SEQ ID NO: 530589 - DNA, 499 bp, Homo sapiens
  misc_feature: HEFZJCU01EK9B9.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcagtgagatctgaggacacggctatttattactgtgcgagaggggaagtggggatattgtggtcagctccgaggtcgcccacggccccggt

SEQ ID NO: 530590 - DNA, 506 bp, Homo sapiens
  misc_feature: HEFZJCU01CNZIX.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagtactccgtgaagggccgattcaccgtctccagagacaattccaggcacacgctgtatctgcaaatgaacagcctgagagctggaggacacggctgtgtattactgtgacgaaagactttactatagaggtcgacggtac

SEQ ID NO: 530591 - DNA, 451 bp, Homo sapiens
  misc_feature: HEFZJCU01D0A4R.51.12.B01.1.454.heavy.3.raw
cgatcgtatacacgaccggtgctcgatttagtagtgtagattccgcgggcacgaccggtgctcgatttagacgtctcatcaaggaaggaaggggctggagtggggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctcgtagcact

SEQ ID NO: 530592 - DNA, 394 bp, Homo sapiens
  misc_feature: HEFZJCU01CH0DY.49.46.E02.1.454.heavy.3.raw
agtcgagagacacgaccggtgctcgatttagactcatctacagggaaaggggcttgagtggattgggagtatatattttactgggacgtcctactacaacccgtccctctaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 530593 - DNA, 402 bp, Homo sapiens
  misc_feature: HEFZJCU01D6LP6.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactat

SEQ ID NO: 530594 - DNA, 483 bp, Homo sapiens; identical to SEQ ID NO: 458705
  misc_feature: HEFZJCU01A4W12.11.23.C01.1.454.heavy.3.raw

SEQ ID NO: 530595 - DNA, 395 bp, Homo sapiens
  misc_feature: HEFZJCU01B919Z.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcgtcttccccctggcgccctgctccaggagcacctccgagagcacagcggccctgggctgcctggtcaaggactacttcctacgtgagct

SEQ ID NO: 530596 - DNA, 497 bp, Homo sapiens
  misc_feature: HEFZJCU01CXNSV.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtggagaaatcctagtggctac

SEQ ID NO: 530597 - DNA, 508 bp, Homo sapiens
  misc_feature: HEFZJCU01EFC1D.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaagggctggagtggggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctatttattgtgtcatagacctaggatacaacgac

SEQ ID NO: 530598 - DNA, 512 bp, Homo sapiens
  misc_feature: HEFZJCU01CJ85U.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtcctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaacccatctccagagacgattccgagaacacggtgtatcttcaaatgaacaacctgagacgccgacgacacggccgtttatactgtgcgagagattcgagtggttcgggacctccacctgttctattcgatc

SEQ ID NO: 530599 - DNA, 539 bp, Homo sapiens
  misc_feature: HEFZJCU01CMYO2.17.28.C06.1.454.heavy.3.raw
  modified_base (451)..(451): a, c, t, g, unknown or other
  modified_base (525)..(525): a, c, t, g, unknown or other
cgtagactagcacgaccggtgctcgatttagagctcacgtattgggtttggggaggtctcagagaggaggcttagccctggactccaaggcctttccacttggtgattcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacggtggactctgtgaagggccgtttcaccatctccagagacaacgccaagaattcactgtatctacaactgaacagcctgagngtcgcagacacggccgtgtacttactgtgcgagatgtaggaaaagtaatggctgtgtttagtggggccagggancccgtggtctaccg

SEQ ID NO: 530600 - DNA, 486 bp, Homo sapiens
  misc_feature: HEFZJCU01CJCV7.51.80.H03.1.454.heavy.3.raw
cgatcgtatacacgaccggtgctcgatttagctgtgcgtcgaagggaaagggggcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctggggaaggacatactacaggtccaagttggtttaatgattatgcagtatctgtgaaagtcgaataaccatcaacccagacacatccaagaaccagttctccctgcaactgaactctgtgacctcccgaggaccacgggccgttgtattactgtgcaagaggtttggttaaac

SEQ ID NO: 530601 - DNA, 499 bp, Homo sapiens
  misc_feature: HEFZJCU01DB8H4.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtgcgtaccgcggggctgacacgtgggacc

SEQ ID NO: 530602 - DNA, 510 bp, Homo sapiens
  misc_feature: HEFZJCU01AO6T5.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtgcagttgtgtggtatgacggaagtaatagaaagtatgccgacgccgtgaagggccgattcaccatctccagagacaattccaacaacatgttgtatctgcaaatgaatagcctgaggagaccggaggacacggcgtgtgttattacgtgtgtcgagacgagtgggaggggggtgggtggtatcctaa

SEQ ID NO: 530603 - DNA, 494 bp, Homo sapiens
  misc_feature: HEFZJCU01CRP5W.3.20.B09.1.454.heavy.3.raw
  modified_base (458)..(458): a, c, t, g, unknown or other
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgcgcagacacggccgtgtattactgtgcgagactggcgcaacagactacggnggcactcctatgcttttgatatctgggccaagggac

SEQ ID NO: 530604 - DNA, 520 bp, Homo sapiens
  misc_feature: HEFZJCU01DV2VZ.40.9.A09.1.454.heavy.3.raw
tctagcgactcacgaccggtgctcgatttagcgagacgcgcagggggtctcagagaggagccttagccctggactccaaggcctttccacttggtgatcagcactgagcacagaggactcaccatggaattggggctgagcgtgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaactatgcggactctgtgaagggccgattcaccatttccagagacaacgccaagaagtcactctctctacacatgaccagcctgacagccgaggacacggctgttttattactgtgcgagagatgggcacgtcggggcggtgactttgactacgtggggccagggg

SEQ ID NO: 530605 - DNA, 483 bp, Homo sapiens
  misc_feature: HEFZJCU01DTIPB.22.36.D03.1.454.heavy.3.raw
  modified_base (433)..(433): a, c, t, g, unknown or other
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggccgccctgctccaggagcacctccgagngcacagcggccctgggctgcctggtcaaggactacttccacgccgtatgt

SEQ ID NO: 530606 - DNA, 493 bp, Homo sapiens
  misc_feature: HEFZJCU01AGLY7.51.38.D05.1.454.heavy.3.raw
cgatcgtatacacgaccggtgctcgatttagtatctgatagtgggtttgggctcaactctcttgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctggacgacacggctcttttttactgtgcgccaggaagcagtggctggccacatcatgcttttgatatctggagccaagggacaatggtcatcgtctcttcggcctccaccaagggcccatcggtcttccccctggccaccctcctccaagagcacctc

SEQ ID NO: 530607 - DNA, 526 bp, Homo sapiens
  misc_feature: HEFZJCU01EOWKR.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagtattcgagtgggttcgggggacctcaccctggttctacttcgatctcgtggggcc

SEQ ID NO: 530608 - DNA, 396 bp, Homo sapiens
  misc_feature: HEFZJCU01DKFAT.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccgccaagggcccatcggtcttccccctggcgccctgctccaggagcacctccgagagcacagcggccctgggctgcctggtcaaggactacttcctacgtgagct

SEQ ID NO: 530609 - DNA, 542 bp, Homo sapiens
  misc_feature: HEFZJCU01DYY8L.14.25.C03.1.454.heavy.3.raw
cgtctagtaccacgaccggtgctcgatttagtagtgtagatttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccagggccatcggtcttcccctggccaccctcctccaagagcacctctgggggcacagcggcccg

SEQ ID NO: 530610 - DNA, 506 bp, Homo sapiens
  misc_feature: HEFZJCU01AMK7T.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcacctttcagttagttatagcatgaactgggtccgccaggctccaggggaaggggctggagtgggtctcatccattagtagtaataggtgcctacagatactacgcagactcactgaagggccgactcaccatctccagagacaacgccaagactcactgtatctgcaaatgaacagcctgagagccgaggacacggctgtgtattactgtgcggagaggagcttaattatcgtcggaaccccg

SEQ ID NO: 530611 - DNA, 533 bp, Homo sapiens
  misc_feature: HEFZJCU01C8V8N.12.40.D07.1.454.heavy.3.raw
  modified_base (219)..(219): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatncactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccgaggggaccctggtcatcgtctccccagcctccaccaagggcccatccggtcttcccccgtggccgcccgtcg

SEQ ID NO: 530612 - DNA, 465 bp, Homo sapiens
  misc_feature: HEFZJCU01BTIG0.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaattttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcaccgtctcctcacgcctccaccaacgggcccatcggtcttccccctggcaccctcctccaagagcacctcgtgggggcacgagcggccctgggctgcctggtcaaggactacttcctcgtactgcg

SEQ ID NO: 530613 - DNA, 491 bp, Homo sapiens
  misc_feature: HEFZJCU01B1FIZ.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgacctcccgaggacgacgggtgtatattactgtggaagacggccccagtacgacatcgccacctcgtctctggtcgcgtt

SEQ ID NO: 530614 - DNA, 518 bp, Homo sapiens
  misc_feature: HEFZJCU01D0REU.51.10.A10.1.454.heavy.3.raw
  modified_base (397)..(397): a, c, t, g, unknown or other
  modified_base (501)..(501): a, c, t, g, unknown or other
cgatcgtatacacgaccggtgctcgatttagcgtcgatctcaggggtctctgagagaggagcccagcccttggattttcaggtgttttcatttggtgatcaggactggacagagagaactcaccatggtttttgggctgagctggttttttcttgtggctatttaaaaggtgtccagtgtgacatgcaactgttggagtctgggggcggcttggttcagccgggggggtccctcagactctcctgttcaacctctggattcaccttttagtggctatgccatgagttgggtccgccaggctccagggaaggggctagagtgggtctcaactattaccagtggtggtggaggcagatactattcagactccgtgaggggccggttcaccgtctccagngacattccaacaacactgtgtctctgctatgagcagcctgagagccgacgacgacggccgtatattactgtgcgaagatctccggggggctagtcttcgtaggntgcgtacctctttttct

SEQ ID NO: 530615 - DNA, 545 bp, Homo sapiens
  misc_feature: HEFZJCU01C3F7Q.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaaagaacaccctttatctgcaaatagaacagcctgagaccagacgacacggctgtctattattgcgcgaagagagacacacgaacctactggccaatactagtgggggcttgttctgggggccgacgggggaccctggtcatcgtcctccccagcctccaccgaacgggcccatccggtccttcccccgtcggccgcccgtcg

SEQ ID NO: 530616 - DNA, 536 bp, Homo sapiens
  misc_feature: HEFZJCU01DU13J.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtccttccccctggccgccctcgctccgacggacgcgaccctcccggagacgcaccagccgggccctcggggcgtcgccgttcggtcaaggactaccgttccgaggtgtccgtctt

SEQ ID NO: 530617 - DNA, 525 bp, Homo sapiens
  misc_feature: HEFZJCU01CS1M8.7.78.H01.1.454.heavy.3.raw
  modified_base (519)..(519): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtgaattgactactgggcagggaaccctggtcacgtctcctcagctccncaaggg

SEQ ID NO: 530618 - DNA, 508 bp, Homo sapiens
  misc_feature: HEFZJCU01D374R.12.14.B03.1.454.heavy.3.raw
atacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaaggcccatcggtcttcccctggcaccctcctccaagagcacctctgggggcacagcggccctgggctgcctggtcaaggactacttcctacgtcgtat

SEQ ID NO: 530619 - DNA, 508 bp, Homo sapiens
  misc_feature: HEFZJCU01CD2X3.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagttttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccgagtctccaggcaaggggcctgcagtgggtggcgtttattcgaagcgatgggactcatgaacaatatgcagactccgtgaagggccgattcatcatctccagagacaactccaacaaccacactggatctccaaatgaacagccctgagagtcgagggaccgacggcccggttaatatttaagttggtcgcccttagactttactaa

SEQ ID NO: 530620 - DNA, 522 bp, Homo sapiens
  misc_feature: HEFZJCU01CKN75.12.40.D07.1.454.heavy.3.raw
atacgacgtacacgaccggtgctcgatttagtgatagagcgtaacaacagagggctcaccatggagtttgggctgagctgggttttcctcgttgctctttttaagaggtgtccagtgtcaggggcacctggtggagtctgggggagccgtggtccagcctgggcggtccctgacactcgcctgtgttgcctctggatttaccttcaatttctattccatgcactgggtccgccaggctccaggcaaggggctcgagtgggtggcacttattgcacatgatggcgtcaacaaattctacgcaaattccgtgaggggccgattcaccatctcccagagacaattacaagaacaccctttaatctgcaaatagacagcctgagaccagacgacacggctgtctattattgcgcgagagagacacacgaacctactggccaatactatggggcttgttctggggccaggggaccctggtcatcgtcttccccacgcctccaccaaggccatcgtcttcccctggcg

SEQ ID NO: 530621 - DNA, 488 bp, Homo sapiens
  misc_feature: HEFZJCU01AGRJ5.3.48.E04.1.454.heavy.3.raw
  modified_base (434)..(434): a, c, t, g, unknown or other
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctggggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggcgattcatcatctccagagacaactccaacaacacactggatctccaaatnaacagcctgagagtcgaggacacggccgtatattattgtcgccttgacttacta

SEQ ID NO: 530622 - DNA, 469 bp, Homo sapiens
  misc_feature: HEFZJCU01EEZP3.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactacttccctacagtgct

SEQ ID NO: 530623 - DNA, 482 bp, Homo sapiens
  misc_feature: HEFZJCU01DTZGQ.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctcctgcagctgacctctgtgactcccgaggacacgggtgtatattactgttggaagaggccccatacg

SEQ ID NO: 530624 - DNA, 492 bp, Homo sapiens
  misc_feature: HEFZJCU01CZX31.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggagtccctcagactctcctgtgcagcgtctggattcagtttcgctacacatggcatgcactgggtccgccagtctccaggcaaggggctgcagtgggtggcgtttattcgaagcgatgggactcgatgaacaatatgcagactccgtgaagggccgattcatcatctccagagacaactccaacaacacactggatcgtcccaaatgaaacagccctgagagtcgaggacacggccgtatattattgtgcccttggattactaa

SEQ ID NO: 530625 - DNA, 522 bp, Homo sapiens
  misc_feature: HEFZJCU01BX6L3.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctgggagtgggttggccgttctagagacacaactaacagtgacaccgcacaatacgccgcgtctgtgaaaggcagattcaccatctcaagagatgattcagagaactcactttatcctgcaaatgaacagcctgagaaccgacgacacggccgtctattattgtgtcatagacctaggatacgaacgacggtggtacctggttattc

SEQ ID NO: 530626 - DNA, 503 bp, Homo sapiens
  misc_feature: HEFZJCU01AVJD5.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagaacgtaaagtgagtggtagtccggggggacacatgacacc

SEQ ID NO: 530627 - DNA, 499 bp, Homo sapiens
  misc_feature: HEFZJCU01B0M84.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctcccagagaccaattccaagaacacgcagtatctgcaaatgaacaggcctgagagctgaggacacggctgtcgtattactgtgggagagatgggaggtcgatagttgta

SEQ ID NO: 530628 - DNA, 529 bp, Homo sapiens
  misc_feature: HEFZJCU01DCF51.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtccaccgtctcctcagcctccaccaa

SEQ ID NO: 530629 - DNA, 531 bp, Homo sapiens
  misc_feature: HEFZJCU01BVYHP.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtcgcccggtacgacccccgtcgactgtagtaaaccggacgtaggttccggaccccgtcgggggccgacggggtaaccccgtgggtaccgaccgttcctcctaccg

SEQ ID NO: 530630 - DNA, 510 bp, Homo sapiens
  misc_feature: HEFZJCU01BRAM3.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttatcggttaccggctacgattggggagcgactggttcgacccctggggccagggaaccctggtcaccgtctcctcagcctccaccaagggcccatcggtcttcccctggccaccctcctccaagagcacctctgggggcacagcggccctgggctgcctggtcaaggactacttcctacgtcgtat

SEQ ID NO: 530631 - DNA, 513 bp, Homo sapiens
  misc_feature: HEFZJCU01AQJ9U.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacaggcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatagaacagcctgagagccgacgacacggccatatattactgtgacgaaagcaccggcagttagtcacccatactactttgactacgtgggccg

SEQ ID NO: 530632 - DNA, 532 bp, Homo sapiens
  misc_feature: HEFZJCU01EQGZB.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctgggagtggatctcacttatttatagtggtggtaccacatactacacagactccgtgaagggccgattcaccatctcagaagacaattccaggaacacattgtatcttcaaatgaataacctgagagccgaggaccacggaccatgtattactgtgtggggcatttacttgacccctggggccggggaaccctggtcaccgtctccccaccctccaccg

SEQ ID NO: 530633 - DNA, 502 bp, Homo sapiens
  misc_feature: HEFZJCU01BYXXX.10.34.D01.1.454.heavy.3.raw
  modified_base (462)..(462): a, c, t, g, unknown or other
catagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtggacaacagagcacgctgcacccgtgaaaggcagattcagcatctcaagagatgattcaaaagtacgactgtatctgaacatagaacagcctgaaaacggaggacanacgccgtgtattactgtgccactcgaggaccgatattgtt

SEQ ID NO: 530634 - DNA, 526 bp, Homo sapiens
  misc_feature: HEFZJCU01C71I8.13.25.C03.1.454.heavy.3.raw
tcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggcccccaggacaagggcttctgtggatggggtggatcaaccctaatagtggtgacacaaactatgagaagaaatttgagggccgggtcaccatgaccagggacacgtccatcaatacaagccttcatggaactgaccagactgacctctgacgacacggcccgtgtattactgtgcggtcggaaactcagcctaactacctttgaattttggggcctagggagccctggtccacgtt

SEQ ID NO: 530635 - DNA, 540 bp, Homo sapiens
  misc_feature: HEFZJCU01B0RCJ.14.26.C04.1.454.heavy.3.raw
cgtctagtaccacgaccggtgctcgatttagtctagcgactttgggtttgggggtctcagagaggagccttagccctggactccaaggcctttccacttggtgatcagcactgagcacagaggactcaccatggagttggggctaagctgggttttccttgttgctattttagaaggtgtccagtgtgaggtgcagttggtggactctgggggaggcttggtccagcctggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgacagcctgagagccgaagacacggccgtgtattactgtacgagagacgttgggtttaaaacttttgacttatggggccaggggaacctggtcaccgtcgtcctc

SEQ ID NO: 530636 - DNA, 548 bp, Homo sapiens
  misc_feature: HEFZJCU01B4QDX.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccaggggaaggggctggagtgggtggccaacataaagcaagatggaactgccgtagttttacgtggactctgtgaagggccgtttcaccatctccagagacaacgccaagaattcactgtatctacaactgaacagcctgagagtcgcagacacggccgtgtattactgtgcgagatgtaggaaaaatagtggctggttgttttagttggggccaggggtacgccccgtggtcctaccg

SEQ ID NO: 530637 - DNA, 523 bp, Homo sapiens
  misc_feature: HEFZJCU01C6I4O.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcaggtcatatcaattgatggagccataaaattttatagcggactccgtgaacggtcgattcaccatctccagagacaattccaggaacacactgtttctgcaaatgaacagcctgagaattgaggactcgggtatatactactgtgcccgtcgaccccctgacctgataaaccggacttagggttccgaccccgtcggggcccgacggggaacccctagggtccaccggtcctcctccg

SEQ ID NO: 530638 - DNA, 518 bp, Homo sapiens
  misc_feature: HEFZJCU01CP29R.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggtagttattagtccctactttgactacgtggggccagggaactctggtcaccgtctccgcagcctccaccaagggccatcc

SEQ ID NO: 530639 - DNA, 496 bp, Homo sapiens
  misc_feature: HEFZJCU01BBTU0.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccattttatacctggtgcgagagatgcgagggccctcccacatcggttatttctttgactcctggggcccaggggaaccctggcaccgtcctcctc

SEQ ID NO: 530640 - DNA, 513 bp, Homo sapiens
  misc_feature: HEFZJCU01DRY9H.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggccttttgacttcgtggggccgaggggaccg

SEQ ID NO: 530641 - DNA, 530 bp, Homo sapiens
  misc_feature: HEFZJCU01ALTRS.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacacgcggcccgtgggctgcctggtcaaggactaccttccacg

SEQ ID NO: 530642 - DNA, 496 bp, Homo sapiens
  misc_feature: HEFZJCU01C2OO8.49.87.H10.1.454.heavy.3.raw
agtcgagagacacgaccggtgctcgatttagcagtactgcgttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgacgcagcctaggatctgccgacacggccgtatatttctgtgcgagagagatgtctttctatgatagtactagtcattat

SEQ ID NO: 530643 - DNA, 503 bp, Homo sapiens; identical to SEQ ID NO: 465188
  misc_feature: HEFZJCU01D1DHV.10.34.D01.1.454.heavy.3.raw

SEQ ID NO: 530644 - DNA, 555 bp, Homo sapiens
  misc_feature: HEFZJCU01C27D6.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataaatggtggctggatcggggggtagtttgggttccgttgggggccgtacgggggaacccctgggtt

SEQ ID NO: 530645 - DNA, 519 bp, Homo sapiens
  misc_feature: HEFZJCU01BGANB.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccggggaacccctccaccgggcacagcctacatggagctgagcagtctgacacctgacgacacggccgtcattactgtgcgagagccgcgaatatgtggtgcaaagatggtcgttgtttgtttggccggtgaactactggggccagggcaccctggtcaccgtctcctcagcttccaccaaggcccatcggtcttcccctggcgccctgctccacggagcgacctcgtgggggcacgagccggccgtcggcgtgcctggtcaaggacctacttcccaatcc

SEQ ID NO: 530646 - DNA, 529 bp, Homo sapiens
  misc_feature: HEFZJCU01BN9SF.53.64.F09.1.454.heavy.3.raw
cgcgtatacacacgaccggtgctcgatttagcgcgtatacaaggggctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggagggcttggtacagccgggggggtccctgagactctcctgtagagtctctggcttcacctttagagtctatgacatgagttgggtccgccaggctccggggaagggctggagtgggtctcaacgatcagtgatagcggaagtaccacaaactacgccgcctccgtgaagggccgatgcaccgtctcagagacaattcgaaggacactttatatctgcaactcaacagactgacaaccgctgacacggccgtctattactgtgtcaaagagacggaccgctgggacgaggacgccaggaggaaaaatcactactttggactacgtc

SEQ ID NO: 530647 - DNA, 491 bp, Homo sapiens
  misc_feature: HEFZJCU01CZVX4.51.52.E08.1.454.heavy.3.raw
cgatcgtatacacgaccggtgctcgatttagtcgagctctcagagagaaagggggagcatcacccagcaaccacatctgtcctctagagaaccccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatgtgccacaaactatgcacagacttttcagggctgggtcaccatgaccagcgacacatctagcaacacagtctacatggagttgacagcctgaccgacacggcccgtgttatttttgtgtgagagattttcggacaatccagtagacccctgtc

SEQ ID NO: 530648 - DNA, 514 bp, Homo sapiens
  misc_feature: HEFZJCU01A8LEE.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggcccatatattactgtgcgaaagcaccggcagttagtcacccatactactttgacttacgtggggaccg

SEQ ID NO: 530649 - DNA, 538 bp, Homo sapiens
  misc_feature: HEFZJCU01EC0YG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctaactggccaatactatgggggcttgttctgggggccgagggggaccctcgggtcatcgtctccccagccctccaccaacgggcccactcggtcttccccctggccgccgtcg

SEQ ID NO: 530650 - DNA, 527 bp, Homo sapiens
  misc_feature: HEFZJCU01EAEDW.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatccagcacagtctaacatggatctgagcggactgacctctggacgaccgacggccagttgtatttacgttgtagggaaaggagtacgtttgggtcgggcgttacccggcgggggccgttgacccgacgtcc

SEQ ID NO: 530651 - DNA, 485 bp, Homo sapiens
  misc_feature: HEFZJCU01DFEW6.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtcatcagcacgtccatcagcacagcctacatggacctgacgcggcctggacatcgtcgacgaccgacggccgtatagtttctgtgcgaggg

SEQ ID NO: 530652 - DNA, 480 bp, Homo sapiens
  misc_feature: HEFZJCU01EGC0A.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccaggcaaggggctggagtgggtggcaattatatggtatgatggaagtaataaagactatgtggactccgtgaaggccgattcaccatctccagagacaactccaagaacactctgtttctccaaatgaacagcctgagaggcgaggacacggcagtgtattactgtgcgagagatcgac

SEQ ID NO: 530653 - DNA, 535 bp, Homo sapiens
  misc_feature: HEFZJCU01DXQ9J.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagtcgtggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactccctccataaaacacagcctacatggagttgaggagcctgacatctagacgacacggccgtctattactgtgcgagacgtcccacgattccggtgagcccgtaacgggccaaggccgggtccttttggacctttcgtcggggggccgagggggacc

SEQ ID NO: 530654 - DNA, 505 bp, Homo sapiens
  misc_feature: HEFZJCU01EUSKN.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggtttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgagttcaccatctccagagacaattccaagaacatgtgtatctgcaaatgaccagcctgagagaccggacggacacggggtgtttattacgtgttggggaagaagtaccctaagtgg

SEQ ID NO: 530655 - DNA, 486 bp, Homo sapiens
  misc_feature: HEFZJCU01DO4LK.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccagtcaagcacagcctacatggacctgagccggccgtgacagtctagacgacgacgccgtatatttcctgtgcgtaggg

SEQ ID NO: 530656 - DNA, 532 bp, Homo sapiens
  misc_feature: HEFZJCU01A1VV4.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttgataactagggggccgtaggggactccgtggtcaccgtctcctcacgcctccaccaac

SEQ ID NO: 530657 - DNA, 501 bp, Homo sapiens; identical to SEQ ID NO: 465562
  misc_feature: HEFZJCU01E0GF6.26.23.C01.1.454.heavy.3.raw

SEQ ID NO: 530658 - DNA, 515 bp, Homo sapiens
  misc_feature: HEFZJCU01DKI8D.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctaccataaacacagcctacatggagttgaggagcctgacatctgacgacacggccgtctattactgtgcgtagacgtcccacggatcccgggtgagccgtaggccaaggcggcctttagaccttcgtc

SEQ ID NO: 530659 - DNA, 506 bp, Homo sapiens
  misc_feature: HEFZJCU01A8N7J.17.25.C03.1.454.heavy.3.raw
cgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataacacagcctacatggagttgaggagcctgacatctgacgacacggccgtctattactgtgcgagagtcccacgatccggtgacgcctacggcaggcggtcc

SEQ ID NO: 530660 - DNA, 515 bp, Homo sapiens
  misc_feature: HEFZJCU01BAFBL.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggcctgggctgcctggtcaaggactacttccagacgt

SEQ ID NO: 530661 - DNA, 512 bp, Homo sapiens
  misc_feature: HEFZJCU01AT067.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctggggatggatcagcggtttcgatgagaaaaccagttctgcacaaaagttccagggcagactcaccctgactacagacgcatcaacgggctcagccttcatgaccctgacggaacctgagacctgacgacgcggcatctattactgtgcgagagactggggtggcagactcgtctcaggaattgacttcgtcgggggccccggaacc

SEQ ID NO: 530662 - DNA, 499 bp, Homo sapiens
  misc_feature: HEFZJCU01EWXLH.49.30.C08.1.454.heavy.3.raw
  modified_base (453)..(453): a, c, t, g, unknown or other
agtcgagagacacgaccggtgctcgatttagtctgacgtcaaagggaaagggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacgacgggtgtatattactgtgngagaggggaagtgggatattgtagatggcgccaggtcgcccggccc

SEQ ID NO: 530663 - DNA, 538 bp, Homo sapiens
  misc_feature: HEFZJCU01BZNK2.48.14.B03.1.454.heavy.3.raw
agtatacatacacgaccggtgctcgatttagtgtgagtagttccgcgggggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatggggttgggtccgccaggccccagggaaggggctgcagtgggtggccaacacaaatcaaaatggaaacgtggagtactatgcggagtctgtgaagggccgggttcaccatctacagagacaacggcaagaagtcgctgttctgcaatgaacagcctgacctccgacgacacggctctctattattgtgtgagagaatcctggggaccggccgtcttcggggggccagggaacactggttatcgtctcttcacg

SEQ ID NO: 530664 - DNA, 565 bp, Homo sapiens
  misc_feature: HEFZJCU01DRWM0.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagtttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccacagacacggctgtttattactgttcgagacatgccgaccgagacgcattatcggctaagtacggtttttaggacttaagttttggggggccgaacgggggacgtaaacgggggtcctaccggttccgttcccggccgtaacgcccttacccaaacccc

SEQ ID NO: 530665 - DNA, 541 bp, Homo sapiens
  misc_feature: HEFZJCU01BIVXR.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggttttggactggttctcccatggaatccctactttgagtactgggggccgcggagccctggtcaccgtctcctcagcctccaccaagggcccatcggtcttcccctggcaccctccc

SEQ ID NO: 530666 - DNA, 518 bp, Homo sapiens
  misc_feature: HEFZJCU01BHFFS.12.75.G09.1.454.heavy.3.raw
  modified_base (448)..(448): a, c, t, g, unknown or other
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctggggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccaacgaccaccagccctacatacgagctgcgcagcctgagatctgaagacacggccatttattactgttgcgagagaatgcacggggccctcccacnttcggttattttccgtttgaccttccgtcgggggccacggggaacccctgggtcccaccgtcttcctccg

SEQ ID NO: 530667 - DNA, 404 bp, Homo sapiens
  misc_feature: HEFZJCU01CKBVM.16.24.C02.1.454.heavy.3.raw
tgtactactccacgaccggtgctcgatttagtacagatcgttagggaagggctggagtgggtctcaagtattagtggtgttggtggtctcacatattacgcagactccgtgaagggccggttcaccgtctccagagacaattccaagaatacactgtatctgcgaatgaatggcctgagagccgaagacacggctgtgtatttactgtgcgagaggtcttactatagttcggggagttaatataacgacgtatttcgatctgtggggccgtggcaccctggtctctgtctcctcagcctccaccaagggcccatcggtcttcccctggcaccctcctccaagagcacctctgggggcacagcggccctgggctgcctggtcaaggactacttccgagtagtaca

SEQ ID NO: 530668 - DNA, 514 bp, Homo sapiens
  misc_feature: HEFZJCU01B1D31.7.28.C06.1.454.heavy.3.raw
  modified_base (454)..(454): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttgggactctgtgaggggccgattcatcatctccagagacaacgccgacaactcactgtctctgctgatgagcagcctgagagccgacgacacggctatctatactntgcgaaactctcattccgttcatctgaatactcgggggccagggaaccctggtcgtcccg

SEQ ID NO: 530669 - DNA, 511 bp, Homo sapiens
  misc_feature: HEFZJCU01DKFRX.17.25.C03.1.454.heavy.3.raw
cgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctatttactggtgcgagatccgacgatcccggtgacgacctacggcaggcgtccg

SEQ ID NO: 530670 - DNA, 530 bp, Homo sapiens
  misc_feature: HEFZJCU01ESGXO.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgttgcgagccacaccgattacgatttttggagtggccttgataaactggggccgagggggatcctggtcaccgtctcctcagcctccacctaac

SEQ ID NO: 530671 - DNA, 519 bp, Homo sapiens
  misc_feature: HEFZJCU01BIJ7W.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacattctacggagactccatggagggccattcaccatctccagagacttttctctagaacacactgtctcttcaaatgaacagcctgagggccgaggacacggccgtctattattgtgtgagtagtttatggcgatggcgtggtggacagatcacgtgggccgtaac

SEQ ID NO: 530672 - DNA, 494 bp, Homo sapiens
  misc_feature: HEFZJCU01CX1FL.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttccccctcggcaccctcctccaagagcacctctgggggcacagcggccctgggctgcctggtcaaggactacttccgagtgcgtct

SEQ ID NO: 530673 - DNA, 504 bp, Homo sapiens
  misc_feature: HEFZJCU01EQ698.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgacgactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgacaatgaacagcctgagagtcgaggacacggctgtgtattactgtgcgagagatccgggaggggtacgtatggacc

SEQ ID NO: 530674 - DNA, 526 bp, Homo sapiens
  misc_feature: HEFZJCU01ECAXG.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggacgcacctccgagagcacagccggccctgggctgcctggtcaaggactacttcccgtgtctgat

SEQ ID NO: 530675 - DNA, 524 bp, Homo sapiens
  misc_feature: HEFZJCU01EWFW9.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaaggcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcacctatctccagggacaacgccaagaactcactgactttgcaaatgaacaccctgcgagccgaggacacggccgtatattactgtgcgagaataacccgttcgcctggttatttaccg

SEQ ID NO: 530676 - DNA, 539 bp, Homo sapiens
  misc_feature: HEFZJCU01BTHIL.13.36.D03.1.454.heavy.3.raw
tcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgtttcactacttatgctatgaattgggtgcgacaggctcctggacaagggcttgagtggatgggatggatcgacatcaacactgggaacccaacgtatgcccagggcttcacaggacggtttgtcttctccttggacacctctgtcacgcacggcgtatgtacagatcagcagcctaaaggctgaggacactgccatttattactgtgtgagagatttcttttcctttgtactacgggtacctttcgtcgttccctttgaccttactggggggcccagggggtaaaccccg

SEQ ID NO: 530677 - DNA, 511 bp, Homo sapiens
  misc_feature: HEFZJCU01BPGBJ.5.57.F02.1.454.heavy.3.raw
atcagacacgcacgaccggtgctcgatttagctcgatatagttgggtttggggaactctgagagaggagcccagccctgggattttcaggtgttttcatttggtgatcaggactgaacgagagcgaactcaccatggagtctgggctgacctggctttttcttgtgactattttaaaaggtgtccactgtgacgtgcagatcttggagtctgggggacgcttcgagcggccggggggatccgtgagactctcctgctcaacctctggattcacatttgtcctttacgccatgacttgggtccgccaggctccagggagggggccagagtgcgtcgcaagtattggcagtgtgaaatttgacaccttatatgcagactctgtgaggggccgcgttcaccgtgtccagagacaactccaagaaccgccgtctatttgcagatggacagcctgagagtcgacgacacggggcagtctattattgtacggcggccgagcaatactctcttacttt

SEQ ID NO: 530678 - DNA, 523 bp, Homo sapiens
  misc_feature: HEFZJCU01CRHSX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttctcaaatgaacagcctgagagccgatgacacggccgtgtattacgtgtgcgagagagtcggggcccacgaacgttactacgctatggacgtctggggcccaaggggaccg

SEQ ID NO: 530679 - DNA, 487 bp, Homo sapiens; identical to SEQ ID NO: 462750
  misc_feature: HEFZJCU01CTWEK.17.36.D03.1.454.heavy.3.raw

SEQ ID NO: 530680 - DNA, 524 bp, Homo sapiens
  misc_feature: HEFZJCU01AKLW8.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccggcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacgaggtttgggggccggggaaccctgggtcaccgtcaactccg

SEQ ID NO: 530681 - DNA, 427 bp, Homo sapiens; identical to SEQ ID NO: 472148
  misc_feature: HEFZJCU01DPOZ6.51.77.G11.1.454.heavy.3.raw

SEQ ID NO: 530682 - DNA, 372 bp, Homo sapiens
  misc_feature: HEFZJCU01EMHP0.49.30.C08.1.454.heavy.3.raw
agtcgagagacacgaccggtgctcgatttagtctgacgtcaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgctggtcaaggactacttcctctctcgact

SEQ ID NO: 530683 - DNA, 501 bp, Homo sapiens
  misc_feature: HEFZJCU01BIRBK.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtcccacgagaacagactatttggagttgagcagcctgagatctgacgacacggccgtttattactgtgcgcgagataatagtcacaactaggaacgggtcggttttgggggt

SEQ ID NO: 530684 - DNA, 501 bp, Homo sapiens
  misc_feature: HEFZJCU01E1FO7.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctatatgtgcgagagtcccacgatccggtgagcctacggcagcggcctttgacttctc

SEQ ID NO: 530685 - DNA, 515 bp, Homo sapiens
  misc_feature: HEFZJCU01DANN1.9.34.D01.1.454.heavy.3.raw
  modified_base (444)..(444): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagagcgaggacacggccatttatttctgtgcgaaggaggcatatgggaagtacgattttcgatccctccgcagtcgacactttgattactggggccgggaaccctggtcgccgtctcctcagcctccaccaagggcccatcgggtcttcccccgtggcnccctcctccaagagcacctcgtgggggcacagcgccctggctgctggtcaaggctacttccagacgtatca

SEQ ID NO: 530686 - DNA, 526 bp, Homo sapiens
  misc_feature: HEFZJCU01DRB9P.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccgaggcgggagttccaagtactacctttgacgtcgtc

SEQ ID NO: 530687 - DNA, 538 bp, Homo sapiens
  misc_feature: HEFZJCU01CY25P.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccggggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtaggaaacagttatgggttggggggtaggtttgggtttttttttacgttacgtacggtagt

SEQ ID NO: 530688 - DNA, 502 bp, Homo sapiens
  misc_feature: HEFZJCU01BMJ0S.19.86.H09.1.454.heavy.3.raw
tactctcgtgcacgaccggtgctcgatttagtgctatagacttgggtttgggagcatcacccagcaaccacatctgtcctctagagaatcccctgagagctccgttcctcaccatggactggacctggaggatcctcctcttggtggcagcagccacctgagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggcgcgtcaccatggccaaggtcgcgtccacgaatacagtgtatatggacttgagcagcctgaggtctgacgacacggccatgtattattgtgcgaggcagggacgggggctaaaaggcaataaagtgggtttaccc

SEQ ID NO: 530689 - DNA, 522 bp, Homo sapiens
  misc_feature: HEFZJCU01C2HXY.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaaacaatctgagagtcgacgatacggctgtctatcattgtgttttcgatgccttcggtccgcgggacttctggggccagggaaccct

SEQ ID NO: 530690 - DNA, 547 bp, Homo sapiens
  misc_feature: HEFZJCU01CMCAD.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcgacacgggcgtttattactgtgcgagagggacggactacggtgactacgtgggggttacgaccccgtgggggcccacggggaaccccgtgggtccgaccgtccgtcctccacgtccctcccgaacccg

SEQ ID NO: 530691 - DNA, 509 bp, Homo sapiens
  misc_feature: HEFZJCU01EU1Z9.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaagggctggagtgggtttcatatattgatagaaatagtggaaccatatactatagcagactctgtgaggggccgattcaccatctccagagacaatgccaggaattcactgtatgtggaaatgaacagtctgagagccgagaacacggcgtctctattactggtgcgagacgccccgaaaagtagggtcgtaac

SEQ ID NO: 530692 - DNA, 492 bp, Homo sapiens
  misc_feature: HEFZJCU01ECY5A.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctccagagacagtgccaagaactcactgtatctgcaaatgaacagcctttagagagaccccgacacggctgtgtattactgtgcgagagatccgctg

SEQ ID NO: 530693 - DNA, 518 bp, Homo sapiens; identical to SEQ ID NO: 448653
  misc_feature: HEFZJCU01DHD60.13.76.G10.1.454.heavy.3.raw

SEQ ID NO: 530694 - DNA, 483 bp, Homo sapiens
  misc_feature: HEFZJCU01AURO8.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacgg

SEQ ID NO: 530695 - DNA, 557 bp, Homo sapiens
  misc_feature: HEFZJCU01C62CM.17.28.C06.1.454.heavy.3.raw
cgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagacgacaacgccaagaattcactgtatctacaactgaacagcctagagagtcgcagacacggccgtgtattactgtgcgagtatggtagggaaaaagtaagtaggcgttgtgttttagttcgggggtccaggggagccccgtggtcctacccg

SEQ ID NO: 530696 - DNA, 513 bp, Homo sapiens
  misc_feature: HEFZJCU01DPLRZ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagttgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccagatccggtgagccgtacggcacggccggtccttttggacctttgtc

SEQ ID NO: 530697 - DNA, 514 bp, Homo sapiens
  misc_feature: HEFZJCU01BLB8Q.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggctactactattatggtatgg

SEQ ID NO: 530698 - DNA, 523 bp, Homo sapiens
  misc_feature: HEFZJCU01B0CJ6.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtacttactgtgcgagagacccctccggatagcagtggctggtccactaggtttgactactggggccagggaagcttggtcaccgtctcctcacgcct

SEQ ID NO: 530699 - DNA, 509 bp, Homo sapiens
  misc_feature: HEFZJCU01EUNTS.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtctcacccatcctccgggacagacttaccatgaccacgaactcctccataaacacagcctacatgggagttgaggagcctgacatctgacgacacggccgtctattactgtgcgagagtcccagtactccggtgacgcctacggcaggcggcctttgacctttcgtc

SEQ ID NO: 530700 - DNA, 515 bp, Homo sapiens
  misc_feature: HEFZJCU01BRVH4.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggagttattacgtccctactttgactacgtgggccagggaactcgtgtcaccgtctccgcagcctccaccaaggccatcc

SEQ ID NO: 530701 - DNA, 505 bp, Homo sapiens
  misc_feature: HEFZJCU01AI6AP.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgagggccgattcaccatctccagagacgattccaagaacacgttgtatcttcaaatgaacagcctgacagtcgacgacacggccatgtatttttgtgcgagcgaccggggctcctcaatggctttcattacg

SEQ ID NO: 530702 - DNA, 535 bp, Homo sapiens
  misc_feature: HEFZJCU01B9LN2.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactggtccgccaggctccagggaagggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctgaaagcgtcaactactactactacggtatggacctctgggaccg

SEQ ID NO: 530703 - DNA, 494 bp, Homo sapiens
  misc_feature: HEFZJCU01B3Q7E.51.83.H06.1.454.heavy.3.raw
  modified_base (413)..(413): a, c, t, g, unknown or other
cgatcgtatacacgaccggtgctcgatttagatcacgtgcgtcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacncgactgtatctccaaatgaacagcctcagtatactgaggactacggctatctactactgtgtgaaagtattgggtttcagt

SEQ ID NO: 530704 - DNA, 511 bp, Homo sapiens
  misc_feature: HEFZJCU01DHYOH.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgatacatcggctatgcggactctgtgaagggccgattcaccatctccagagacaacgccaagaactccctgtatctgcaaatgaacagtctgagacctgaggacacggccttgtattactgtagtaaagtcccggggaaatagtgtacgtattttta

SEQ ID NO: 530705 - DNA, 515 bp, Homo sapiens
  misc_feature: HEFZJCU01CASH2.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaattgaacagcctaagtcctgaggacacgggtgtatactactgtacgaaggaggggggaaccaggcgggagttcaagtactccttgacgtctggggcc

SEQ ID NO: 530706 - DNA, 436 bp, Homo sapiens; identical to SEQ ID NO: 444686
  misc_feature: HEFZJCU01CARWJ.40.27.C05.1.454.heavy.3.raw

SEQ ID NO: 530707 - DNA, 519 bp, Homo sapiens
  misc_feature: HEFZJCU01CQ3E8.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctacatttccgttcatctgtaatacgtggggcctaggggaacccctggtcgtcccg

SEQ ID NO: 530708 - DNA, 530 bp, Homo sapiens
  misc_feature: HEFZJCU01CXBCI.7.78.H01.1.454.heavy.3.raw
  modified_base (510)..(510): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcaccagggcggtttgtcttctccatggatacctctgtcgggacggcttatctgcagataaccaaccttcaacctgacgacactgccgttttatttttgtacgagagcgtcgtctgtcagtggtaattgactactggggccagggaaccctggtcnccgtctcctcagcctcacca

SEQ ID NO: 530709 - DNA, 475 bp, Homo sapiens
  misc_feature: HEFZJCU01EGDP2.16.10.A10.1.454.heavy.3.raw
  modified_base (431)..(431): a, c, t, g, unknown or other
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttccccctggcaccctcctccagagcacctctgggggcacngcggccctgggctgcctggtcaaggactacttccgagtagtaca

SEQ ID NO: 530710 - DNA, 506 bp, Homo sapiens
  misc_feature: HEFZJCU01DOY12.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgttacttactggtggggagaaggagtgggaggtacgattagttagtta

SEQ ID NO: 530711 - DNA, 436 bp, Homo sapiens; identical to SEQ ID NO: 470400
  misc_feature: HEFZJCU01A5E0O.40.27.C05.1.454.heavy.3.raw

SEQ ID NO: 530712 - DNA, 429 bp, Homo sapiens; identical to SEQ ID NO: 447944
  misc_feature: HEFZJCU01BTFRS.4.37.D04.1.454.heavy.3.raw

SEQ ID NO: 530713 - DNA, 485 bp, Homo sapiens
  misc_feature: HEFZJCU01DH1SY.48.38.D05.1.454.heavy.3.raw
agtatacatacacgaccggtgctcgatttagtatctgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaaagccacgagcacagtctacatgcagctgagcagcctgagacacaacgacacggcgtctattattgttccagagataatcgcgtgaataaagat

SEQ ID NO: 530714 - DNA, 561 bp, Homo sapiens
  misc_feature: HEFZJCU01BM9E2.4.1.A01.1.454.heavy.3.raw
  modified_base (281)..(281): a, c, t, g, unknown or other
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccgganaaaacctgacgtggatgggttggatcaatggtgaaactggaaaaaccaaatattcaccgagcttccagggcagaatgacatctcccgggacacatccgcgagcgcaatctatctggactgagccgcctgacatctgcaggactcggcagtatatttctgtgcgaggagagggggaggacttggggttagaggggaaatttgggttttaattccgtacgtttaaccttacgtttttacgacctaaccgttcggggggaccctaacggggggtaaacccccg

SEQ ID NO: 530715 - DNA, 390 bp, Homo sapiens; identical to SEQ ID NO: 444541
  misc_feature: HEFZJCU01ERIR2.16.24.C02.1.454.heavy.3.raw

SEQ ID NO: 530716 - DNA, 508 bp, Homo sapiens
  misc_feature: HEFZJCU01C21O0.48.81.H04.1.454.heavy.3.raw
agtatacatacacgaccggtgctcgatttagtagtgtagattcgcgggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggaggagctcggttttacggagttatcatctactactttgaattc

SEQ ID NO: 530717 - DNA, 528 bp, Homo sapiens
  misc_feature: HEFZJCU01BHEPD.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgttgctatttcaaaaggtgtccagtgtgaggtgcagttggtggagactggaggaggcttgatccagcctggggggtccctgagactctcctgtgcagtctctgggttcgtcagttggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcagtttactgaccctggggccgggaacctggtcaccgtctccccaccctccaccg

SEQ ID NO: 530718 - DNA, 519 bp, Homo sapiens
  misc_feature: HEFZJCU01B0PLP.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcacatctccagggacaacgccaagaactcactgactttgcaaatgaaccaccctgcgagccgaggacacggccgtatattactgtgcgagaataaccgttcgcctggttacttacc

SEQ ID NO: 530719 - DNA, 509 bp, Homo sapiens
  misc_feature: HEFZJCU01BKOU6.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatatttactgtgcacagagagtacgggcagcacggtgggtttcggggctacgtgggggccaggggaaccctggtccaccgtccgtcctcagcctaccaaccc

SEQ ID NO: 530720 - DNA, 558 bp, Homo sapiens
  misc_feature: HEFZJCU01B0HWP.48.3.A03.1.454.heavy.3.raw
agtatacatacacgaccggtgctcgatttagagagcgtcacaacagaggggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcggatcacaaaatacgcggactccgtgaaaggccgcttcaccgtctccagagacaacggcgagaatactctgtatttgcagatgaagaaatctgagaggcgaggacaccgcgctttattattgtacacgtcgttttacttttctaatggtggtctcttacggaacgacacgttgacctttagttgggggtccgggggtaacccgtcgggtacctaccc

SEQ ID NO: 530721 - DNA, 499 bp, Homo sapiens
  misc_feature: HEFZJCU01ECL6D.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatgggaaatagtgacttctattcagactccgtgaagggccgattcaccgtctccagagacaattccaggcacacgctgtatctgcaaatgaacagcctgagagctgaggacacggctgtgtattactgtgcgaagatttctatagaggtgacgtacgggggcgttcg

SEQ ID NO: 530722 - DNA, 526 bp, Homo sapiens
  misc_feature: HEFZJCU01A8UE7.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctgggagtggggttggccgttctagagacacaactaacagtgacaccgcacaatacgccgcgtctgtgaaaggcagattcaccatctcaagagatgattcagagaactcactttatctgcaaatgaacagacctgacgaacccgacgacacggccgtctatttattgtgttcatagacctaggatacaacgacggtggtacctggtacttc

SEQ ID NO: 530723 - DNA, 492 bp, Homo sapiens
  misc_feature: HEFZJCU01ES5KP.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctaccaaatgaacagcctgagagtcggaggacacggccgtaattattattgtgtcccttgatttacta

SEQ ID NO: 530724 - DNA, 499 bp, Homo sapiens
  misc_feature: HEFZJCU01D7QIH.11.57.F02.1.454.heavy.3.raw
  modified_base (442)..(442): a, c, t, g, unknown or other
  modified_base (479)..(479): a, c, t, g, unknown or other
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaagggctggaatggatttcatacattagcagtagtggtgcgacctatatactacgcagactctgtgaagggccgattcatcatctccagagacaatggacaacaactcactgtatctaggaatcaacnacctgagagtcgaggacacggctgatagttattgtgngagagccccgtacggtgacg

SEQ ID NO: 530725 - DNA, 486 bp, Homo sapiens
  misc_feature: HEFZJCU01DPWRR.51.67.G01.1.454.heavy.3.raw
  modified_base (471)..(471): a, c, t, g, unknown or other
cgatcgtatacacgaccggtgctcgatttagagtatacatattgggtttgggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggactgagagctgaagacacggctagtatattacngtgcgaacttatcac

SEQ ID NO: 530726 - DNA, 482 bp, Homo sapiens
  misc_feature: HEFZJCU01C2P08.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacatttgactactggggccagggaaccctcgtcaccgtctcctcagcctccaccaagggcccatcggtcttcccctggcaccctccccaagagcacctctgggggcacagcggccctgggctgcctggtcaaggactacttcctagagacacg

SEQ ID NO: 530727 - DNA, 505 bp, Homo sapiens
  misc_feature: HEFZJCU01AH5M3.53.26.C04.1.454.heavy.3.raw
cgcgtatacacacgaccggtgctcgatttagtctagcgactttgggtttggggggagcatcaccctgcaaccacagctgtcctctagagaatccccagagagctccgttcctcaccatggactggacctggaggatcctcttcttggtggcagcagccacaggagcccactcccaggtgcatctagtgcaatctcggctgaggtaaagaagcctggggcctcagtgaaggtctcctgcaaggcctctggatacaccttcaccgactactatatgcactgggtgcgacaggcccctggaaagggcttgagtggatgggatgggtcaatcctaacagtggcggcagcggtctcacagaatatgcacagaagtttcagggcagggtctcccatgaccagggacaggggccatcagaacagcctacatggagctgaacagactgaacatctgacgacgacggtccgttttaagttatttgtgtgagagaacgggacccgatcgacctcc

SEQ ID NO: 530728 - DNA, 489 bp, Homo sapiens
  misc_feature: HEFZJCU01CN7VE.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctcaggagcacctccgagagcacagcggccctgggctgcctggcaaggactacttccgtatctctcg

SEQ ID NO: 530729 - DNA, 500 bp, Homo sapiens
  misc_feature: HEFZJCU01E1I9M.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaaggcccatcggtcttcccctggcaccctcctccaagagcacctctgggggcacagcggcctggctgcctggtcaaggactacttccgctacgtaga

SEQ ID NO: 530730 - DNA, 499 bp, Homo sapiens
  misc_feature: HEFZJCU01C6H47.4.25.C03.1.454.heavy.3.raw
agcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttattggtatgatggaagtaagaaatactatgcagagtccgtgaagggccgattcaccatctccagagacaattccaacaacacgctgtttctgcaatgaacagcctgagagccgaggacacggctgtgtatcactgtgtcagagatgccgagggcggttaccccg

SEQ ID NO: 530731 - DNA, 505 bp, Homo sapiens
  misc_feature: HEFZJCU01BK1UA.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccggggacagacttaccatcgaccacgaactcctccataacacagcctacatggagttgaggagcctgacatctgacgacacggccgtctattactgtgcgagacgtccacgatccggtgagcctacggcaggcggcctttgacttctc

SEQ ID NO: 530732 - DNA, 485 bp, Homo sapiens
  misc_feature: HEFZJCU01CUB0H.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggccctggacaaggggcctgagtggatggggagaatcaacccgagtggaggtggtgcagagtacgcccagaggtttcagggcaggagtctccatgaccagtgacacggtccgcgagcactgctatatggagatgaggagcctgagacttgacgacacggccgtatattactgtgcgagaatcgaagaaggtggctac

SEQ ID NO: 530733 - DNA, 525 bp, Homo sapiens
  misc_feature: HEFZJCU01BGL5N.17.25.C03.1.454.heavy.3.raw
  modified_base (459)..(459): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacttgggtgcgccaggccgctggacaacgacctgagtggatgggatgggcgaaccctaacactggtgtcacagtgtcttcacccatccctccgggacagacttaccatgaccacgaactcctccaataaacacagcctacatggagttgaggagcctgacatctgacgacaccggccgtctattactgtgngagacgtcccacgattccggtgacggcccgtaccgggcaggccggtcccttttggacctttcggtc

SEQ ID NO: 530734 - DNA, 507 bp, Homo sapiens
  misc_feature: HEFZJCU01BEOXD.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctggaggtctgacgacacggccctctattattgtgcgagaatttaatttcgttattgttctggtgtgtgtgttcaatgtttgacctattc

SEQ ID NO: 530735 - DNA, 573 bp, Homo sapiens
  misc_feature: HEFZJCU01EN93L.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattacaaaaagcacgctgtatctgcaatgaacagcctgagaaccgacggacacagccgtgtattactgtaccaacactccccttagaaaacgtcggtacaactacttaactaccgttacggtacgttcggaccttccgtggggtaccgaaacggggtaacccg

SEQ ID NO: 530736 - DNA, 508 bp, Homo sapiens
  misc_feature: HEFZJCU01DW5AT.47.48.E04.1.454.heavy.3.raw
  modified_base (445)..(445): a, c, t, g, unknown or other
  modified_base (484)..(484): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaatggacagcctgagngtcgaagacacggctgtgtattactgtgtgtctctgacncctcggcccggaccttggcttcgg

SEQ ID NO: 530737 - DNA, 523 bp, Homo sapiens
  misc_feature: HEFZJCU01CNYAA.21.76.G10.1.454.heavy.3.raw
tcgtcgctcgcacgaccggtgctcgatttagtcactcatacaggggctgggagaggagcccagcactgggattccgaggtgtttccattcggtgatcagcactgaacacagaggactcaccatggagtttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccaatgagctgggtccgccaggctccagggaagggctggagtgggtctcagttatttatagtggtggtggtgcagattacgcagactccgtgaagggccgattcaaccatctccagagacaattccatgaacacgctgtatcttcaaatgaacagcctgagagccgacgacacggccgtctattactgtgcgacgggagtgacggggagggagggcagtggatacgtttgacctacgtggggggccg

SEQ ID NO: 530738 - DNA, 516 bp, Homo sapiens
  misc_feature: HEFZJCU01EJB9S.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaacccgtggtcaccgtctcctcacgcctcccaccaagggcccatcggtcttcccctcggcaccctcctccaacgagcacctctcgggggcacagcggccctgggctcgcctggtcaaggactacttcgtact

SEQ ID NO: 530739 - DNA, 540 bp, Homo sapiens
  misc_feature: HEFZJCU01B8NU9.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagaacagcctgagaccagaccgacacggctgtctattattgcgcgagagagacacacgaacctactggccaatactatgggggcgttgttctggggccgaggggacccgtggtcatcgtctccccacgcctccaccaacgggcccatcgggtccttccccctcggccgcccgtcg

SEQ ID NO: 530740 - DNA, 551 bp, Homo sapiens
  misc_feature: HEFZJCU01DSTO6.48.34.D01.1.454.heavy.3.raw
agtatacatacacgaccggtgctcgatttagatcgtctgtgttgggtttggggggaaaaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggccgccctgctccaggagccacctccgagacggcaccacgccgggcccgtcggggcctgtcccgtggttaccgaagggaacttaacctttcccttaatcggttactta

SEQ ID NO: 530741 - DNA, 509 bp, Homo sapiens
  misc_feature: HEFZJCU01BW8II.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaacccgtggtcaccgtctcctcagcctccaccaaggcccatcggtcttcccctggcaccctcctccaagagcacctcgtggggcacagcggccctgggctgccctggtcaggactacttccgtacta

SEQ ID NO: 530742 - DNA, 508 bp, Homo sapiens
  misc_feature: HEFZJCU01B2OM0.17.25.C03.1.454.heavy.3.raw
  modified_base (460)..(460): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaactcctccataaacacagcctacatggagttgaggagcctgacatctgacgacacggccgtctattactgtgcgagngtcccacgactccggtgacgcctacggcagcggccttttgacttcgtc

SEQ ID NO: 530743 - DNA, 525 bp, Homo sapiens
  misc_feature: HEFZJCU01B9RTS.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttcggacctgagccggcctggacgaccgtggaggactaccggccatttacctacttgtgcggcggggtaggtggacggagccttcggttttcggagtttatccatctactactttgaattc

SEQ ID NO: 530744 - DNA, 531 bp, Homo sapiens
  misc_feature: HEFZJCU01DP7XF.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctgggagtggatctcacttatttatagtggtggtaccacatactacacagactccgtgaagggccgattcaccatctcagaagacaattccaggaacacattgtatcttcaaatgaataacctgagagccgaggacacggccatgtattaactgtgtgggggcatttacttgacccctggggccggggaaccctggtcaccgtctccccaccctccacc

SEQ ID NO: 530745 - DNA, 509 bp, Homo sapiens
  misc_feature: HEFZJCU01DQJ4Y.11.72.G06.1.454.heavy.3.raw
  modified_base (397)..(397): a, c, t, g, unknown or other
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccaggacagagtcaccctgaccacagagacatccacgaccanagtctacatggagctgtggagcctgagactgacgacgacggccctctattactgtgcgacggccctatcctacagtcgaccactccacgctggttcgacctctggggccaac

SEQ ID NO: 530746 - DNA, 507 bp, Homo sapiens
  misc_feature: HEFZJCU01DXUGV.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattctagttcgagacgggctagtctggggattcgtagtttatagtgtactcgtcgttctggggccg

SEQ ID NO: 530747 - DNA, 512 bp, Homo sapiens
  misc_feature: HEFZJCU01D3PN9.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctgggagtggggtctcatccattagtagtaatagtgcctacagatactacgcagactcactgaagggccgactcaccatctccagagacaacgccaagaactcactgtatctgacaaatgaaacagcctgagagccggaggacacggctgtgttattactgtgcgagaggagctattatcgtaggaaccccgatggtt

SEQ ID NO: 530748 - DNA, 498 bp, Homo sapiens
  misc_feature: HEFZJCU01D3AQR.17.86.H09.1.454.heavy.3.raw
cgtagactagcacgaccggtgctcgatttagtgctatagacttgggtttggggtctgggagaggagccccagccctgagattcccaggtgtttccattcagtgatcagcactgaacacagaggactcaccatggagttggggactgagctggattttccttttggctactctaaaaggtgtccagtgtgaagtgcagctggtggagtctgggggaggcttggtacagcctggcaggtccctgagactctcctgtgcagcctctggattcacctttgatgattatggcatgcactgggtccgccaagccccagggaaggcctggagtgggtctcaggcattagttggaatggttggtagcatagcctatgcggactccgtgaaggccgattcaccatctccagagacaacgccggaaaacttcccctagtatctgcagatgaacagtctgagagctgaagacaactgccttattatttctgtgtgaaaccatcacgcca

SEQ ID NO: 530749 - DNA, 546 bp, Homo sapiens
  misc_feature: HEFZJCU01EB11R.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaacagcctgagagtcgaggacacggccctttattactgtgcgaaggatcgcccctataatggtggttggagtcggggagtttggttcctggggccaggggaacccctggtctacccg

SEQ ID NO: 530750 - DNA, 524 bp, Homo sapiens
  misc_feature: HEFZJCU01DGT7Q.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcgtttgtcttctccatggatacctctgtcgggacggcttatctgcagataaccaaccttcaacctgacgacactgccgtttattttgtacgagagcgtcgtctgtcagtggaattgactactgggccagggaacctggtcaccgtctcctcagcctccacca

SEQ ID NO: 530751 - DNA, 506 bp, Homo sapiens
  misc_feature: HEFZJCU01D8QDN.48.33.C11.1.454.heavy.3.raw
agtatacatacacgaccggtgctcgatttagagtgagctcgttgggtttggggggattcccaggtgtttccattcagtgatcagcactgaacacagaggactcaccatggagttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctgggagtgggtctcaggcattagtagaattaggggtagcatagcctatgcggattctgtgaagggccgattcaccatctccagagacaacgccaagaactccctgtatctgcaaatgaacagtctgagacctgaggacaccggccttctattactgtgcaaaagatcaggcattagactacaacggtatggacgtctgggggaccaaggg

SEQ ID NO: 530752 - DNA, 520 bp, Homo sapiens
  misc_feature: HEFZJCU01BPF46.40.9.A09.1.454.heavy.3.raw
tctagcgactcacgaccggtgctcgatttagcgagacgcgcaggggaggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggcttgtttattactgtgcgagagatggcacgtcgggggcggtgacttttgactactcgggggcca

SEQ ID NO: 530753 - DNA, 500 bp, Homo sapiens
  misc_feature: HEFZJCU01D62TI.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcggtggtccagcctgggaggtccctgagactctcctgtgcagcctctggattcaccttcagtacctatgcttatgcactgggtccgccaggctccaggcgagggctggagtgggtggcgaattatatcacatgatggaactaatagacgctatgccgactccgtgaagggccgattcaccatctccagagacaattccaagaacacgcagtatctgcaaatgaacagcctgagagctggaggacacggctgtgtatttacgtgtgggagagagtggtagggtcgagta

SEQ ID NO: 530754 - DNA, 511 bp, Homo sapiens
  misc_feature: HEFZJCU01EHMF9.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattactggg

SEQ ID NO: 530755 - DNA, 369 bp, Homo sapiens
  misc_feature: HEFZJCU01E2GWK.19.85.H08.1.454.heavy.3.raw
tactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccaggctccaggaaaggggctggagtggattgcctatgtcactagtgagggcgaagtcacgtcctacgcggact

SEQ ID NO: 530756 - DNA, 515 bp, Homo sapiens
  misc_feature: HEFZJCU01DPUTB.40.2.A02.1.454.heavy.3.raw
tctagcgactcacgaccggtgctcgatttagactcatctacaggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtaactttttggatgacgtgggtccgccaggctccagggaaggggctggagtgggtggccaacataaaagcaaatggacgtctgcaaaactatgtggactctgtgaagggccgattcaccatttccagagacaacgccaagaactcactgttctgcaaatgaacagcctgagagccgaggacacggctgtatattactgtgcgagagatgcggggggtcccgtagtggttcggggaagttattatgat

SEQ ID NO: 530757 - DNA, 525 bp, Homo sapiens
  misc_feature: HEFZJCU01CUID7.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtccttcccctcggccgccctgcctccgaggagcacctccgtgggggcacgacgccggtcccg

SEQ ID NO: 530758 - DNA, 536 bp, Homo sapiens
  misc_feature: HEFZJCU01BSUQ7.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtagaaaagtaatggctgtgtttagtggggtccagggacgcctggtctaccg

SEQ ID NO: 530759 - DNA, 519 bp, Homo sapiens
  misc_feature: HEFZJCU01AF32D.13.63.F08.1.454.heavy.3.raw
  modified_base (497)..(497): a, c, t, g, unknown or other
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggtacggttttgggcggtcggactcctcttgagatcgtgggccgnggggacaatggtcacgtctctc

SEQ ID NO: 530760 - DNA, 496 bp, Homo sapiens
  misc_feature: HEFZJCU01CAEAL.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccaggggaaccctggtcaccgtctcctcagcctccaccaagggcccatcggtcttcccccggcaccctcctccaagagcacctctgggggcacagcggcctgggctgcctggtcaaggactacttccgagtagtaca

SEQ ID NO: 530761 - DNA, 516 bp, Homo sapiens
  misc_feature: HEFZJCU01E1HMH.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaagtctttgatctcgtggggccaagggacactggtccacgtctcttcagcctccaccaagggcccatccggtccttcccccttcggccgccctcgcctccgaggacg

SEQ ID NO: 530762 - DNA, 541 bp, Homo sapiens
  misc_feature: HEFZJCU01C1DI1.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccgaactacaacccgtccctcaggagtcgagtcaccgatatcagtagacacgtccaagaaccagttctccctgaacgctgagctctgtgaccgccgcggacacggctgtgtattactgtgcgagagcggatattgtagtagtaccagctgctatttttcgtaccggttggttccgaccccgttgggggcccacggggaaccctgggtccaccggtctcctcagccctacccg

SEQ ID NO: 530763 - DNA, 510 bp, Homo sapiens
  misc_feature: HEFZJCU01CU7EX.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttatactgtgcgagagtctgggggtggctacgagtactggtacttcgatctctggggccgtggcaccctgctgactgtctcctcagcctccaccaagggcccatcggtcttccccctggcgccctgctccaggacgcacctccgagagcgacacgccggcccgtcgggctcggcctcggtcaacggacttaccg

SEQ ID NO: 530764 - DNA, 513 bp, Homo sapiens
  misc_feature: HEFZJCU01CAFE3.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctcggtccgcgggacttctggggccaggggtaacccg

SEQ ID NO: 530765 - DNA, 521 bp, Homo sapiens
  misc_feature: HEFZJCU01BIMYL.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacggaagggaggggggaaccgagcgggagttccaagtactcctttgacgtcgtc

SEQ ID NO: 530766 - DNA, 504 bp, Homo sapiens
  misc_feature: HEFZJCU01AVNSN.17.27.C05.1.454.heavy.3.raw
cgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggcacctttagcaactatgctttcagctgggtgcgacaggcccctggacaagggcttgagtggatgggagggatcattcctatccttgggacagtaaggtatccacagaagttccagggcaaagtcaccattaccgcggacgaatccacgagcacagcctacattgagttgagcagcctcagatctgaggacacggccgtgtattactgtgcgagagggtccggagacacaatggcagtagtgggaagtgtattgtttttgt

SEQ ID NO: 530767 - DNA, 549 bp, Homo sapiens
  misc_feature: HEFZJCU01DNC1O.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaagggctggagtgggtggccaacataaagcaagatggaactgccgagtttacgtggactctgtgaagggtccgtttcaccatctccagagacaacgccaagattcactgtatctacaactgaacagcctgagagtcgcagacacggccgtgtattactgtgcgagagtggtaggaaaaagtaagtggctggttgtttagttgggggccaaggggacgccccgtggtcctaccc

SEQ ID NO: 530768 - DNA, 535 bp, Homo sapiens
  misc_feature: HEFZJCU01D5MXU.12.40.D07.1.454.heavy.3.raw
  modified_base (402)..(402): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtcaacaattctacgcaaattccgtgaggggccgattcaccatctccagagacaattacaagaacaccctttatctgcaaatagacagcctgagaccagacgacacggctgtctattattncgcgagagagacacacgaacctactggccaatactatgggggcttggttctgggggccagggggaccctggtcatcgtcctccccagcctccaccaagggcccatccggtccttccccctcggccgcccgtcg

SEQ ID NO: 530769 - DNA, 393 bp, Homo sapiens
  misc_feature: HEFZJCU01EDWEC.52.41.D08.1.454.heavy.3.raw
cgcagtacgacacgaccggtgctcgatttagtcacgcgagaaagggaaaggggctggagtgggtttcatacagtagtggttctagtactttcgcaaagtacgcagactctgtgaagggccgattcaccgtgtccagagacaacgccaagaactcaatgtatctgcagatgagcaacctgagagtcgacgacacggctgtttattactgttcgagactagcggatttttgggggcggaatcacttgactactggggccagggagccctggtcaccgtctcctctgcctccaccaagggcccatcggtcttccccctggcaccctcctccaagagcacctctgggggcacagcggccctgggctgcctggtcaaggactacttcctatacgatcg

SEQ ID NO: 530770 - DNA, 504 bp, Homo sapiens
  misc_feature: HEFZJCU01DJ7SH.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccggacaagggcttgagtgggtggggtgggtcagcggctttgacggtaaggcacgagtatgcaccgaagatgaagggcagagtcacgattaccacggacacccccacgaacacagtctacatgcaactgacgagcctgagagctggacgacgacggccgtctattactgtgcgagaatgttttctgtcatcgtacaatttgataggctctatggactggacttcgtc

SEQ ID NO: 530771 - DNA, 539 bp, Homo sapiens
  misc_feature: HEFZJCU01A61L3.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggtccaggggaccctgggtcatcgtctccccagccctccaccaacggggcccacgtccggtcttccccctcggccgcccgtcg

SEQ ID NO: 530772 - DNA, 536 bp, Homo sapiens
  misc_feature: HEFZJCU01DJRHA.18.33.C11.1.454.heavy.3.raw
  modified_base (475)..(475): a, c, t, g, unknown or other
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatcctcagaagacaattccaggaacacattgtatcttcaaatgaataacctgagagccgaggacacggccatgtattactgtgtggggcntttacttgaccccgtggggcccggggaaccctcggtcaccgtcctccccaccctccaaccg

SEQ ID NO: 530773 - DNA, 510 bp, Homo sapiens
  misc_feature: HEFZJCU01D3SID.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatgggaactgaggagcctaagatctgacgacacggccgtttattattgtgcaataagaattgcaaacgatgcttttagatagtgtgggggccaaggggactaacg

SEQ ID NO: 530774 - DNA, 510 bp, Homo sapiens
  misc_feature: HEFZJCU01CY4YI.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctgggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggcgtctattactgtgcgagagtcccacgatccggtgacgcctacggcaggcggccttttgactttctggggccaggggacg

SEQ ID NO: 530775 - DNA, 548 bp, Homo sapiens
  misc_feature: HEFZJCU01CF0YZ.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacggctgcacccgcgaaaggcagattcaccatctcaagagatgattcaaaaagcacgctgtatctgcaatgaacagctgagaaccggaggacacagccgtagttattactgtaccgacactccccgtagaacggcgtacaactactactactacggtatggtacctcgtcggggaccg

SEQ ID NO: 530776 - DNA, 493 bp, Homo sapiens
  misc_feature: HEFZJCU01BSKAI.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctagaaatttgaggacacggcctatttattactgttgcaaggaacagcataatgactcgtccccgg

SEQ ID NO: 530777 - DNA, 517 bp, Homo sapiens
  misc_feature: HEFZJCU01BLTWA.12.86.H09.1.454.heavy.3.raw
  modified_base (509)..(509): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctcaccaagggcccatcggtcttcccctggcgccctgctcagagcacctccgagagcacncgcggccc

SEQ ID NO: 530778 - DNA, 515 bp, Homo sapiens
  misc_feature: HEFZJCU01CDMRM.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacattctacggagactccatggagggccgattcaccatctccagagacttttctcagaacacactgtctcttcaatgaacagcctggaggccgaggacacggccgtctattattgtgtgagagtttatggcgatggctggtggacagatcacgtggggccaac

SEQ ID NO: 530779 - DNA, 505 bp, Homo sapiens
  misc_feature: HEFZJCU01EX6Z6.17.10.A10.1.454.heavy.3.raw
  modified_base (479)..(479): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcgagcggctttgacggtaaggcacagtatgcaccgaagatgaagggcagagtcacgattaccacggaccacccccacgaacacagtctacatgcaactgacgagcctgagagctgacgacacggccgtctattactgtgcgagaatgttttctgtcatcgtacaatttanataggctctatggactggacttcgtc

SEQ ID NO: 530780 - DNA, 495 bp, Homo sapiens
  misc_feature: HEFZJCU01CA47O.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaaacagcctgagagctgaggacacggctgtgtattactgtgggagagagtggaggtcgatattgta

SEQ ID NO: 530781 - DNA, 518 bp, Homo sapiens
  misc_feature: HEFZJCU01BG5TS.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgttcctttgacttactggggcctgggaactcgtggtcaccgtctcc

SEQ ID NO: 530782 - DNA, 522 bp, Homo sapiens
  misc_feature: HEFZJCU01CDZ5Y.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctagtggacgtcgtggggccaagggaccg

SEQ ID NO: 530783 - DNA, 514 bp, Homo sapiens
  misc_feature: HEFZJCU01ELD92.17.25.C03.1.454.heavy.3.raw
  modified_base (261)..(261): a, c, t, g, unknown or other
cgtagactagcacgaccggtgctcgatttagtagtgtagatttgggtttgggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatnaaccctgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttcgtggggccagggtaccg

SEQ ID NO: 530784 - DNA, 500 bp, Homo sapiens
  misc_feature: HEFZJCU01C7NZJ.40.53.E09.1.454.heavy.3.raw
tctagcgactcacgaccggtgctcgatttagagagagtgtgttgggtttggggacccaacaaccacatccctcctcagaagcccccagagcacaactccttaccatggactggacctggaggatcctctttttggtggcagcagccacaggtgcccactcccaggtccagcttgtgcagtctggggctgaggtgaagaagcctggggcctcagtgagggtttcctgcaaggcgtctggatattccttcactacctacactctgcattggctgcgccaggcccccggacacagctttgagtggatggggtggctcaacgctggcgatggaaaaacaaatattcagagaagttccagggcagagtcaccattacaagggacacaatcgcgcgcaatgcttacatggagttgaggagcctgagatctgaagacacggctgtgtattactgtgtgagaggcggatattgtcgtggtggtgactgctacagtcaaaatcgtcggt

SEQ ID NO: 530785 - DNA, 498 bp, Homo sapiens
  misc_feature: HEFZJCU01CMU87.52.57.F02.1.454.heavy.3.raw
cgcagtacgacacgaccggtgctcgatttagctcgatatagttgggtttggggtctgggagacgagcccagcactggaagtcgccggtgtttccattcggtgatcatcactgaacacagaggactcaccatggagtttgggctgagctggggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttctctacaaatgaacagcctgagagctgaggacgacggctatcttttactgttgcgagagggaactcgattacag

SEQ ID NO: 530786 - DNA, 506 bp, Homo sapiens
  misc_feature: HEFZJCU01EGZZS.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctgggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgcctgctccaggagcacctctgggg

SEQ ID NO: 530787 - DNA, 520 bp, Homo sapiens
  misc_feature: HEFZJCU01DOPEG.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttatagagacacaactaacagtgacaccgcacaatacgccgcgtctgtgaaaggcagattcaccatctcaagagaatgattcagagaactcactttatctgcaaatgaacagcctgacgaaccgacgacacggccgtctattattgtgtcatagacctaggatacaacgacggtggtacctggtattc

SEQ ID NO: 530788 - DNA, 501 bp, Homo sapiens
  misc_feature: HEFZJCU01C98CS.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagcgacggacacagccatgtattatttgtacattaggacactatac

SEQ ID NO: 530789 - DNA, 517 bp, Homo sapiens
  misc_feature: HEFZJCU01D0BNY.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacgggacacccccacgaaccacagtctacatgcaactgacgagcctgagagctggacgacacggccgtctattactgtgcgagaacttgttttctgttcattcggttacaaattttgaataggcttctagtggtactggggaccttt

SEQ ID NO: 530790 - DNA, 509 bp, Homo sapiens
  misc_feature: HEFZJCU01CBQA7.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagcccggaggaccacgggccgttttatcacgtgtcgacgaaaagattattgtaatgatgg

SEQ ID NO: 530791 - DNA, 493 bp, Homo sapiens
  misc_feature: HEFZJCU01D4JRY.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggcccgtgggctgcctggtcgaaggactacttccctacagtgct

SEQ ID NO: 530792 - DNA, 500 bp, Homo sapiens
  misc_feature: HEFZJCU01CHBZ4.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtgtattactcggtggggagaggagtggaggtcgatagttgta

SEQ ID NO: 530793 - DNA, 524 bp, Homo sapiens
  misc_feature: HEFZJCU01EPMZX.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggcccggggaacctggtcgccgtctcctcacgcctccaccaacgggcccagtcggtcttccccctggccaccctcctccaagagcacctcgtgggggcacagcggccctgggctgcctggtcaaggactacttccagacgtatca

SEQ ID NO: 530794 - DNA, 511 bp, Homo sapiens
  misc_feature: HEFZJCU01DJDAR.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctacattccgttcatctgaatacgtgggccagggaaccctggtcgccg

SEQ ID NO: 530795 - DNA, 495 bp, Homo sapiens; identical to SEQ ID NO: 450370
  misc_feature: HEFZJCU01BUSOQ.16.37.D04.1.454.heavy.3.raw

SEQ ID NO: 530796 - DNA, 521 bp, Homo sapiens
  misc_feature: HEFZJCU01B760L.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttgggcggcggactcctcttgagatcgtgggccagggggacaagtggtccaccgtcctcttc

SEQ ID NO: 530797 - DNA, 496 bp, Homo sapiens
  misc_feature: HEFZJCU01BGGZB.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggtccagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatcggaggtgaggagcctgagatatgacgacacgggcctgtattattgtgcgagagtggagtggcagtggatatcgacaaattactacttaa

SEQ ID NO: 530798 - DNA, 488 bp, Homo sapiens
  misc_feature: HEFZJCU01CPQAI.4.37.D04.1.454.heavy.3.raw
  modified_base (457)..(457): a, c, t, g, unknown or other
agcactgtagcacgaccggtgctcgatttagtagcatactggttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggtcaggggtcaccatgaccaggggacacggtccatcagcacgtccatcagcacagcctacatggacctgagcggcctgacagtcgtnacgacacggccgtagatttctgttgcgaggg

SEQ ID NO: 530799 - DNA, 531 bp, Homo sapiens
  misc_feature: HEFZJCU01AKYDD.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggacgtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggttagtacatactccgcagactccgtgaggggccgattcaccatcctccagagacaattccaagaacacgctgtttcttcaaatgaacagcctgagagccgatgacacggccgtgtattactgtgcgagagagtcgggggcccacgtaacgttaactacgctatcggacgtctgggggccgaacggggaccg

SEQ ID NO: 530800 - DNA, 499 bp, Homo sapiens
  misc_feature: HEFZJCU01EGDL0.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgacccctggggccagggaccctggtcaccgtctcctc

SEQ ID NO: 530801 - DNA, 492 bp, Homo sapiens
  misc_feature: HEFZJCU01C2OGH.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgactccgtggggccagggaaccctggtcaccgtctcctc

SEQ ID NO: 530802 - DNA, 535 bp, Homo sapiens
  misc_feature: HEFZJCU01A8P7A.48.67.G01.1.454.heavy.3.raw
agtatacatacacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgcgcagacacggctgtctattattgtgcgagactaggcttctgtagtggtggtacttgcaacccgggatactacctccaacttcggccttggactatcgtggggccaagggacctcggtcgtcccg

SEQ ID NO: 530803 - DNA, 480 bp, Homo sapiens
  misc_feature: HEFZJCU01E1XH5.7.10.A10.1.454.heavy.3.raw
  modified_base (426)..(426): a, c, t, g, unknown or other
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctcaccaagggcccatcggtctcccctggcaccctcctccaagagcacctntcgggggcacagcggccctgggctgcctggtcaaggctacttcctagagacacg

SEQ ID NO: 530804 - DNA, 507 bp, Homo sapiens
  misc_feature: HEFZJCU01BRU2J.48.50.E06.1.454.heavy.3.raw
agtatacatacacgaccggtgctcgatttagatctactgacaacacacaagggggagagaggagccttagccctggattccaaggcccagccacttggtgatcagcactgagcaccgaggattcaccatggaactggggctccgctgggttttccttgttgctattttagaaggtgtccagtgtgaggtgcagttggtggaatctgggggaggcctggtcaagccgggggggtccctgagactctcttgtgcagcctctggattcaccttcagtagatatgtcatgatttgggtccgccaggctccagggaaggggctggagtgggtctcatccattagtagtaatagtgattacatatattatgcagaatcactgaagggccgattcaccatctccagagacaacgccaaagagtctctgtttctggacatgaccagcctgagagccgaagacacggctacatattactgtgcgaaagttcggtctggagtcgttggtattttgtt

SEQ ID NO: 530805 - DNA, 529 bp, Homo sapiens
  misc_feature: HEFZJCU01BT9LA.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaattaacgaacacagtaatctggagctgaacagcctgtcatctgaggacacgggcttctacttctgtgcgaggagtaattactataacactgctccttttacacctccttgacttctcggggccagtcggaaccccggtcaccgt

SEQ ID NO: 530806 - DNA, 522 bp, Homo sapiens
  misc_feature: HEFZJCU01DX7F0.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtgcagttgttcatctgagggcagtgttcaatggtatgcagactccgtgaagggccgattcaccatctccagagacaattccaggaacacaatgtatttggaaatgaacagacctaagtcctgaggacgacgggtgtatactactgtacgaaggaggggggaaccaggcgggagttaccaagtaccttaccg

SEQ ID NO: 530807 - DNA, 489 bp, Homo sapiens
  misc_feature: HEFZJCU01EAMSW.11.13.B02.1.454.heavy.3.raw
  modified_base (475)..(475): a, c, t, g, unknown or other
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggacgcacctccgagagcacagcggccctgggctgcctggtcaggacncttcgtatctctcg

SEQ ID NO: 530808 - DNA, 509 bp, Homo sapiens
  misc_feature: HEFZJCU01A5UYF.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggccttcgggtttctctagtgccgtcggtttgtagtaactcggggaccgacggggtaactcgtggtcgtaccggtcctccctc

SEQ ID NO: 530809 - DNA, 490 bp, Homo sapiens
  misc_feature: HEFZJCU01AXDLI.48.71.G05.1.454.heavy.3.raw
agtatacatacacgaccggtgctcgatttagtgtcgtcgcaagagagaggggggcatcacataacaaccacattcctcctctaaagaagtccctgggagcacagctcttcaccatggactggacctggaggttcctctttgtggtggcagcagcaacaggtgtccagtcccaggtgcggctggaacaatctggggccaagtgaggaagcctgggtcctcagtgaagatctcctgcctggcctctggaggcaccttcaatcactatgctttcaactgggtgcgacaggtccctggacaaggacttgtgtggatgggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgtcttat

SEQ ID NO: 530810 - DNA, 518 bp, Homo sapiens
  misc_feature: HEFZJCU01BTX2S.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataagccggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtccatatctacaaatggatagcctagaaaatcgagatacaggtgtttattatcgttcacagggaatgcggttctcgtggggtccgagggtac

SEQ ID NO: 530811 - DNA, 497 bp, Homo sapiens
  misc_feature: HEFZJCU01EDCYB.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctaggaatcaacagcctgagagtcgaggacacggctgtatattattgtgcgagacgcccctacggtgcg

SEQ ID NO: 530812 - DNA, 509 bp, Homo sapiens
  misc_feature: HEFZJCU01BA3Q3.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggaccaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccagtgtattacgtgtggaagagacgttggtggctaccggcggggctagaccacgtcggggacccg

SEQ ID NO: 530813 - DNA, 482 bp, Homo sapiens
  misc_feature: HEFZJCU01AF8H0.11.63.F08.1.454.heavy.3.raw
  modified_base (396)..(396): a, c, t, g, unknown or other
cgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccgggctactatatgcactgggtgcgacaggcccctggacaagggcttgagtggatgggacggatcaaccctaatagtggtggcacaaactatgcacagaagtttgagggcagggtcatcatgaccagggacacgtccatcancgacagcctacatggagctgagcaggctgacgatctgacgtcacggccgtgtattactgtgcgagagataaaggggatgtgatacg

SEQ ID NO: 530814 - DNA, 397 bp, Homo sapiens
  misc_feature: HEFZJCU01BL3KU.10.42.D09.1.454.heavy.3.raw
  modified_base (346)..(346): a, c, t, g, unknown or other
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggcccatcggtcttccccctggcgccctgctccaggagcacctccgagngcacagcggccctgggctgccctggtcaaggactacttcccactacctatg

SEQ ID NO: 530815 - DNA, 526 bp, Homo sapiens
  misc_feature: HEFZJCU01BAGJ0.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacgaattacaagaacaccctttatctgcaaatagacagccctgagaccagacgacacggctgtctattattgcgcgagagagacacacgaacctactggccaatactatgggggcttgttctgggggccaggggaccctggtcatcgtctccccagcctccaccaagggcccatcggtcttccccctggccg

SEQ ID NO: 530816 - DNA, 515 bp, Homo sapiens
  misc_feature: HEFZJCU01ESPXK.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtggaggggccgattcaccatctccagagacaattccaagaacacgctgtttcttcaaatgaacagcctgagagccgatgacacggccgtgtattactgtgcgagagagtggggcccacgaacgttactacgctatggacgtcgtaggggcc

SEQ ID NO: 530817 - DNA, 507 bp, Homo sapiens
  misc_feature: HEFZJCU01DGKYN.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgagccctatcctacagtgaccgactccacgctggttcgacctctggggcctac

SEQ ID NO: 530818 - DNA, 465 bp, Homo sapiens; identical to SEQ ID NO: 446628
  misc_feature: HEFZJCU01CWVAF.48.59.F04.1.454.heavy.3.raw

SEQ ID NO: 530819 - DNA, 504 bp, Homo sapiens
  misc_feature: HEFZJCU01EC99K.21.19.B08.1.454.heavy.3.raw
tcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcaagtgcagggccgattcaccatctccagagacaacgccaagaattccctgtatctgcaaatggacagcctgagagtcgaggacacggctagtgtattactgtgcgggtgcgtggggacgggatgacagctgggccaac

SEQ ID NO: 530820 - DNA, 511 bp, Homo sapiens
  misc_feature: HEFZJCU01D5AGB.51.81.H04.1.454.heavy.3.raw
cgatcgtatacacgaccggtgctcgatttagtagtgtagattcgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcgggggcagggtcatcatgaccggggacacgtccatcgccacaacttacatggaactgaccagtctgacatttgacgacacggccgtctattactgtgcgacagaagcggcggacagaggttcgcttactggttcgaggctcctccccacg

SEQ ID NO: 530821 - DNA, 548 bp, Homo sapiens
  misc_feature: HEFZJCU01EEWDF.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaaacgacggtgtatttgcaaatgaacagcctagaaaaccgaggacacagccgtctacttactgtaccacagattcggaagttgacagtcgacgtaaaggaggctatgtctttgatatcgtcggggccgaggac

SEQ ID NO: 530822 - DNA, 545 bp, Homo sapiens
  misc_feature: HEFZJCU01EKQRL.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgtatttttggatgtctggggccaaggtacagcggtcaccgtcgcctcacgcctccaccgaacgggcccacgtccggtccttccccccgtcgggccaccccgttccctcccaagacgccacctccgtggggggccacgac

SEQ ID NO: 530823 - DNA, 506 bp, Homo sapiens
  misc_feature: HEFZJCU01DGDHW.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccgagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggcgaccttggcttcg

SEQ ID NO: 530824 - DNA, 518 bp, Homo sapiens
  misc_feature: HEFZJCU01EGY68.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagaggggacggacgacggtgactacttgggggttcgcccgtcgggccgagggaaccctggtcaccgtctcctca

SEQ ID NO: 530825 - DNA, 502 bp, Homo sapiens
  misc_feature: HEFZJCU01EU20T.11.57.F02.1.454.heavy.3.raw
cgagagataccacgaccggtgctcgatttagctcgatatagttgggtttgggggctctcagataggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcggaggacacggctgtatattattgtgcgagacgcccccgtacggtgtacg

SEQ ID NO: 530826 - DNA, 502 bp, Homo sapiens
  misc_feature: HEFZJCU01BVVPK.48.77.G11.1.454.heavy.3.raw
agtatacatacacgaccggtgctcgatttagctagtcactcaagggaaaggggtctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggcctgtgtattactgtgcggagaggctagtcactatgggtttc

SEQ ID NO: 530827 - DNA, 526 bp, Homo sapiens
  misc_feature: HEFZJCU01EYMKG.3.17.B06.1.454.heavy.3.raw
  modified_base (463)..(463): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttattttacaaggtgtccagtgtgaggtgcacctggtggagtctgggggaggcttggtccagcctgggagggtccctaagactctcctgtgcagcctctggactcaccttcacgctcaatggccactacgtggactgggtccgccaggctccagggaaggggctggagtgggttggccgttctagagacacaactaacagtgaccaccgcacaatacgccgcgtctgtgaaaggcagattcaccatctcaagagatgattcagagaactcactttatctgcaaatgaacagctgaagaccgacgaacncgccgtctattagttgtgtcataagacctagggatacgaacgacgggtgtaacctgggtattc

SEQ ID NO: 530828 - DNA, 518 bp, Homo sapiens
  misc_feature: HEFZJCU01CW543.10.38.D05.1.454.heavy.3.raw
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaacgggccggttcaccctctccagagacacttccaacaacattacttgtatcttcacatgcacaatactgagagtcgacgacacggccacctacttatttgtgcggcgacactgactacggctacaatttctggggtccagggac

SEQ ID NO: 530829 - DNA, 533 bp, Homo sapiens
  misc_feature: HEFZJCU01CNRNG.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgactttttggggtccagggaaacctggtcaccgtcctccccagccttccaccaacgggcccatcggtcctttcccccg

SEQ ID NO: 530830 - DNA, 519 bp, Homo sapiens
  misc_feature: HEFZJCU01DZS7E.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccggaccgttggagtcagggaactctggtcaccgtctcctcagcctccaccaagggcccatcggtcttcccctggccgccctgctccaggagcacctccgagagcacagcggcccgtgggctcgg

SEQ ID NO: 530831 - DNA, 529 bp, Homo sapiens
  misc_feature: HEFZJCU01B57K3.11.25.C03.1.454.heavy.3.raw
cgagagataccacgaccggtgctcgatttagtagtgtagatttgggtttggggggggagaggagcccagcactgggattccgaggtgtttccattcggtgatcagcactgaacacagaggactcaccatggagttttggctgagctgcgttttccttgttgctatttttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaacgggaccg

SEQ ID NO: 530832 - DNA, 498 bp, Homo sapiens
  misc_feature: HEFZJCU01CL8YE.51.37.D04.1.454.heavy.3.raw
  modified_base (451)..(451): a, c, t, g, unknown or other
  modified_base (492)..(492): a, c, t, g, unknown or other
cgatcgtatacacgaccggtgctcgatttagtagcatactgttgggtttggggagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaaggggctgcagtgggtctcacatattagtgctaatgggagaaccacattctacgcagactctgtgaagggccgattctccatctccagggacaacgccaagaactcactgtatctgcaaatgaacagtctaagngaccgaagacacggccgtgtacttctgtgcgagtgtggagnggtacg

SEQ ID NO: 530833 - DNA, 528 bp, Homo sapiens
  misc_feature: HEFZJCU01A61TP.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaccctggtcaccgtctcctcacgcctccaccagg

SEQ ID NO: 530834 - DNA, 510 bp, Homo sapiens
  misc_feature: HEFZJCU01BLA2U.17.10.A10.1.454.heavy.3.raw
  modified_base (418)..(418): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagngactgacgacacggccgtctattactgtgcgagaatgttttctgttcatcgtactaatttgataggtctcctatggtactggacctttcgtc

SEQ ID NO: 530835 - DNA, 504 bp, Homo sapiens
  misc_feature: HEFZJCU01C54I8.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaaggcttctggattcacgtttacctcctatagtatcaactgggtgcgccaggccgctggacgacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccaacgatccggtgagtcctacggcagcggctttgacttcgtc

SEQ ID NO: 530836 - DNA, 521 bp, Homo sapiens
  misc_feature: HEFZJCU01BSWAI.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggggtccgccaggctccagggaaggggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 530837 - DNA, 522 bp, Homo sapiens
  misc_feature: HEFZJCU01DBHDE.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctcccttaaaattgacctctgtgagcgctgcagacacggccgtctattactgtgcgagactgcggggctattatggttcgggagatcccagtggttttgatatatggggccgaggggacagcggtcaccgtctcttc

SEQ ID NO: 530838 - DNA, 511 bp, Homo sapiens; identical to SEQ ID NO: 448871
  misc_feature: HEFZJCU01DM7CO.3.34.D01.1.454.heavy.3.raw

SEQ ID NO: 530839 - DNA, 504 bp, Homo sapiens
  misc_feature: HEFZJCU01BOO93.22.30.C08.1.454.heavy.3.raw
acatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatctgggggggccttggtccagcctggggggtccctgagactcgcctgtgcagcctctggattcgagtttggagcctactgtctgacttgggtccgccaggctccagggaaggggctggagtgggtggccagcatcaacgaagacggacataaggaattttatgtggcctctgtgaagggccgattccaccatcctccagagacaacgtcaagaactcactgttctgcagatggacagcctgcgagccgaggacacggctgtcttatttctgtgtcagagacgagatactacagtattctta

SEQ ID NO: 530840 - DNA, 515 bp, Homo sapiens
  misc_feature: HEFZJCU01DZV99.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcaggggtcatcatgaccggggacacgtccatcgccacaacttacatggaacgtgaccagtctgacatttgacgacacggccgtctattactgtgcgacagaagcggcggacagaggttcgcttactggttcgaggctccgtccccacgg

SEQ ID NO: 530841 - DNA, 496 bp, Homo sapiens
  misc_feature: HEFZJCU01A5OWA.14.25.C03.1.454.heavy.3.raw
cgtctagtaccacgaccggtgctcgatttagtagtgtagatttgggtttggggaggacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggaggtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatgggaggtcgatattgta

SEQ ID NO: 530842 - DNA, 500 bp, Homo sapiens
  misc_feature: HEFZJCU01DQNY2.49.84.H07.1.454.heavy.3.raw
  modified_base (486)..(486): a, c, t, g, unknown or other
agtcgagagacacgaccggtgctcgatttagcagacgtctgtcgcggggggctgggagtcgagcccagcactgggagtcgccggtgtttccattcggtgatcatcactgaacacagaggactcaccatggagtttgggctgaactgggttttcctcgttgctcttttaagaggtgtccagtgtcaggtgcagttggtggagtctggggggaggcgtggtccagcctgggaggtccctgagactctcctgtgcagcctctggattcaccttcaatagttatggtttgcactgggtccgccaggctccaggcaagggtctggagtgggtggcttttatatcctatgatggtagcgataagtactacgcagattccgcgaagggtcgattcaccatctccagagacaagtccaagaagaacgctgtatctggacatgaccagcctgagatctgaggacacggctgtctacttctgtgcgagagcacgancagcgagtcacccg

SEQ ID NO: 530843 - DNA, 510 bp, Homo sapiens
  misc_feature: HEFZJCU01DX3M5.9.12.B01.1.454.heavy.3.raw
  modified_base (395)..(395): a, c, t, g, unknown or other
  modified_base (439)..(439): a, c, t, g, unknown or other
  modified_base (482)..(482): a, c, t, g, unknown or other
  modified_base (499)..(499): a, c, t, g, unknown or other
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatntccagagacaattccaggaacacgctgtatcttcaaatgaacancctgagagtcgaggacacggctgtatattactgtgcgagaagntgtgtacgcttttgatntctggggaccg

SEQ ID NO: 530844 - DNA, 506 bp, Homo sapiens
  misc_feature: HEFZJCU01DG217.14.12.B01.1.454.heavy.3.raw
cgtctagtaccacgaccggtgctcgatttagtagtgtagatttgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctgggccgagggaaccctggtcaccgtctcctcagcctccaccaagggcccatcggtcttcccctcggcaccctcctccaa

SEQ ID NO: 530845 - DNA, 533 bp, Homo sapiens
  misc_feature: HEFZJCU01B3QN7.49.59.F04.1.454.heavy.3.raw
agtcgagagacacgaccggtgctcgatttagtacacacacttagggattgggggcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatgggggaggatcatccctattgttggtgtgacaaactacgcacagaagttccgaggacagaatcacgataaccgcggacacatccacgagcacttattttcatggaactgagcagcctcagatccggaggacgacgggccgtttactactggtgcggagcgatcccggattccccgtcgtttccggaggatgacttacgtgggggcccgacggggtacccg

SEQ ID NO: 530846 - DNA, 523 bp, Homo sapiens
  misc_feature: HEFZJCU01AHSUD.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacgacgggtgtatactactgtacgaagggaggggggaaccgaggcgggagttccgaagtacttccg

SEQ ID NO: 530847 - DNA, 503 bp, Homo sapiens
  misc_feature: HEFZJCU01CE2TK.51.1.A01.1.454.heavy.3.raw
cgatcgtatacacgaccggtgctcgatttagacgtctcatcaggggggagagggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacattccgagaacacgctgtatctgcaaatgaacagcctgagaggttgaggacgacggctggttgttattattgtggcgaaactttaatcacggaggacaaacgggtcc

SEQ ID NO: 530848 - DNA, 514 bp, Homo sapiens
  misc_feature: HEFZJCU01EE5MF.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacaagccacatattactgttcacgctctatggttcggggagttattagtccctactttgctactggggccagggactctggtcaccgtctccgcacgcctccaccaagggcccc

SEQ ID NO: 530849 - DNA, 485 bp, Homo sapiens
  misc_feature: HEFZJCU01AOBFY.48.38.D05.1.454.heavy.3.raw
agtatacatacacgaccggtgctcgatttagtatctgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataagccacgagcacagtctacatgcagctgagcagcctgagacacaacgacacggccgtctattattgttccagagaataatcgcgtgaataaagat

SEQ ID NO: 530850 - DNA, 519 bp, Homo sapiens
  misc_feature: HEFZJCU01DL16T.12.40.D07.1.454.heavy.3.raw
atacgacgtacacgaccggtgctcgatttagtgatagagcgtaacaacgagaggactcaccatcggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgagggccgattcaccatctccagagacaattacaagaacaccctttatctgcaaatagacagcctgagaccagacgacacggctgtctattattgcgcgagagagacacacgaacctactggccaatactatgggggcttgttctggggccagggaccctggtcatcgtctcccagcctcaccaagggcccatcggtcttcccctggcg

SEQ ID NO: 530851 - DNA, 529 bp, Homo sapiens
  misc_feature: HEFZJCU01EGY7Y.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctatttttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattacttgtgcgagagagtcggggcccacggaacgttaactacgctatggacgtcgtggggccgagggaaccg

SEQ ID NO: 530852 - DNA, 558 bp, Homo sapiens
  misc_feature: HEFZJCU01DT57Y.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcccgcaagccttctggatacatcttcactacttattctgtcaattgggtccgacaggcccctggacaaggccttgactacatgggatgggatcaacaccgacactgggaaccccacctatgcccaggccttcacagggcggtttgtcttctccatggatacctctgtcgggacggcttatctagcagactaaccaaccttcaacctgacgacactgccgttttattttgtacgagagcgtcgtctgtcagtggtaattgacttactggggccaggggaaccctggtactccggtccttaccgtccagccctccacccgtaaagggcccctacg

SEQ ID NO: 530853 - DNA, 484 bp, Homo sapiens
  misc_feature: HEFZJCU01C73ME.52.8.A08.1.454.heavy.3.raw
cgcagtacgacacgaccggtgctcgatttagcatactctacaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgatcatcatctccagagacaactccgagaacacgctgtatctgcaatgaacaggctgagagctgaagacgacggctgtatagttactgtgacgtaacttaataccg

SEQ ID NO: 530854 - DNA, 467 bp, Homo sapiens
  misc_feature: HEFZJCU01D1U22.48.7.A07.1.454.heavy.3.raw
  modified_base (425)..(425): a, c, t, g, unknown or other
agtatacatacacgaccggtgctcgatttagcacgtgtcgcaggggcagggtgtacacctgtggttctcggggctgtcctttggttttggagatggttttctcgatggggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctcgtgggggcacngcggccctgggctgcctgtcaaggactactcctatgtatact

SEQ ID NO: 530855 - DNA, 529 bp, Homo sapiens
  misc_feature: HEFZJCU01A0ABW.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggagtacagtggcagctccaagtactactttgacttctggggccagggaaccctaggtcaccgtctcctcagcctccaccaaggcccatcggtcttcccctggcgccctgctccacggagcacctccgagacg

SEQ ID NO: 530856 - DNA, 505 bp, Homo sapiens
  misc_feature: HEFZJCU01DVZ60.17.25.C03.1.454.heavy.3.raw
cgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataacacagcctacatggagttgaggagcctgacatctgacgacacggccgtctattactgtgcgagagtcccacgatccggtgagcctacggcagcggtccg

SEQ ID NO: 530857 - DNA, 438 bp, Homo sapiens
  misc_feature: HEFZJCU01BF2FR.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccattggagtttgggctgagctgggttttcctcgttgctcttttaagaggtgtccagtgtcaggtgcagctggtggagtctgggggaggcgtggtccagcctgggaggtccctcagactctcctgtttagcccttctggattcaccttcagtagttattcctttgactacgtgggtccgtcaagggtcctccaggtcaaggggctggagtgggtggcagttatctcatttgatggagacaataaatacttacagagactcccggttacggggccgagttccacctaacctccaacaacgtaacttagtagaacaacg

SEQ ID NO: 530858 - DNA, 499 bp, Homo sapiens
  misc_feature: HEFZJCU01C3WGE.11.27.C05.1.454.heavy.3.raw
  modified_base (477)..(477): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaagggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagagngctattatctcggaaccccgat

SEQ ID NO: 530859 - DNA, 530 bp, Homo sapiens
  misc_feature: HEFZJCU01DD2B1.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaagggctggagtgggtggccaacataaagtacgatgaagttgagataattattggactctgtgaagggccgattcaccatctcgagggacaacgccaagaactcgctgtatctgcaaatggagagcctgagagccgaggacacggctgtatattattgtgtgagattagcgcactactttgactacgtggggaccaggggaaccctggtccaccgt

SEQ ID NO: 530860 - DNA, 510 bp, Homo sapiens
  misc_feature: HEFZJCU01DN9SO.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtagttccggggggtacgacgatgactacc

SEQ ID NO: 530861 - DNA, 520 bp, Homo sapiens
  misc_feature: HEFZJCU01AVDS1.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctgggtccaccgtctccgcagcctccaccaagggccccatcc

SEQ ID NO: 530862 - DNA, 515 bp, Homo sapiens
  misc_feature: HEFZJCU01BP1UU.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcgttacccctctggttccttcgacagttatggtatggacgtcgtggggcctagggactacggtcaccgtctcctcagcctccaccaaggcccatcggtccttccccgtggcta

SEQ ID NO: 530863 - DNA, 553 bp, Homo sapiens
  misc_feature: HEFZJCU01CACUE.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttacaaatgaataacctgagagccgaggacacggccatgtattactgtgtggggctatttactttcgaccccgtggggggcccggggtaaacccgttgggtcctaaccggtcctcccccaccccttcccaacccg

SEQ ID NO: 530864 - DNA, 506 bp, Homo sapiens
  misc_feature: HEFZJCU01B0H3D.49.26.C04.1.454.heavy.3.raw
agtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtaggagcctggggggtccctgagactctcctgtgcagcctctggattcatctttgatgattatgccatgcactggatccgtcaagctccggggaaggtctggagtgggtctctcttattaattgggatgggtggtatcacctactatgcagactctgtgaagggtcgattcaccatctccagagacaacagcagaaacctccctagtatctgcaaatgaacagtctcagaggtgaggacaccgctcctactactgtgacaaagtattacggtcgaccgacaccta

SEQ ID NO: 530865 - DNA, 487 bp, Homo sapiens
  misc_feature: HEFZJCU01CE16E.52.19.B08.1.454.heavy.3.raw
cgcagtacgacacgaccggtgctcgatttagtgagtcagtaagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggagcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaaggccgattcatcatctccagagacaactccgagaacacgctgtatctgacaaatgatcaggctgagagctgaagacacggtctttatattactgtgcgaacttaatcaggagactaac

SEQ ID NO: 530866 - DNA, 478 bp, Homo sapiens
  misc_feature: HEFZJCU01DT8B4.14.70.G04.1.454.heavy.3.raw
cgtctagtaccacgaccggtgctcgatttagtgtagtgtgaagggaaagggtccctaaaactctcctgtacaacctcaggattcgcctttcgcatctatgccatggcctgggtccgccagattccagggaaggggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccgaagggcccatcggtcttccccctggcaccctcctccaagagcacctctggggcacagcggcctgggctgcctggtcaaggactacttccgtactagacg

SEQ ID NO: 530867 - DNA, 516 bp, Homo sapiens
  misc_feature: HEFZJCU01D9IOR.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatggaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcc

SEQ ID NO: 530868 - DNA, 502 bp, Homo sapiens
  misc_feature: HEFZJCU01EFQ22.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctggggacgcggtccatcagcacagtctacatggaatctgagcggactgacctctgacgacacggccatgtattactgtggagagacgttggtggctaccgcggggctgaccactggggccg

SEQ ID NO: 530869 - DNA, 522 bp, Homo sapiens
  misc_feature: HEFZJCU01B2BX8.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactgggagtgggtctcatccattagtcctggtggtacttctatatactactcagactcagtgaggggacgattcaccatctccagagacaacgccgcgagttcagtgtttctgcagatgcacaacttgagagtcgaagacacggcggtctattctgcgcgaggaaaagtcgcattccagagcctgtacgcccgccttggtctcgtcagttggtcaatccgccctccagggggacctttgggggtttcgaccccgtggggccaggggaaccctggtcaccgtctcctcagcctccaccagggcccatcggtcttccccctggcaccctctccaagagcc

SEQ ID NO: 530870 - DNA, 528 bp, Homo sapiens
  misc_feature: HEFZJCU01DWVB0.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagagtcggggccacggaacgttactaccgctagtggacggtctggggaccgaacgggtaaccg

SEQ ID NO: 530871 - DNA, 514 bp, Homo sapiens
  misc_feature: HEFZJCU01C9FFL.51.26.C04.1.454.heavy.3.raw
cgatcgtatacacgaccggtgctcgatttagtctagcgactttgggtttggggtctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggt

SEQ ID NO: 530872 - DNA, 515 bp, Homo sapiens
  misc_feature: HEFZJCU01B65OO.48.17.B06.1.454.heavy.3.raw
agtatacatacacgaccggtgctcgatttagtcgatagtgaaggggctcagagaggtggcttagccctggactccaaggcacttccacttggtgatcagcactgaacacagaggacccaccatggaggtggggctgtgttgggctttcctcgctgttatcttagaaggtgtccactgtgaaattcaactagtggagtctgggggaggattggttcagcctggagggtccctgaaactctcctgtctggccactggattcagattcagtcgacatgaaatgagttgggtccgtcaggctccggggaagggtctggagttgattgcacacattgacttacagtggcagtattgaacaatatggagacagtgtgaggggccgcgtcacgatctccagaaaggacgacgaaaattctctattttagagatgaccaatgtgacaaatggaggacacggctctgtactactgtgccagaggagacgattacgaccgctcggagaggggtcttacgcctttt

SEQ ID NO: 530873 - DNA, 505 bp, Homo sapiens
  misc_feature: HEFZJCU01D3TRD.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacctggtgtcacagtgtcttcacccatcctccgggacagacttaccatgaccacgaactcctccataaacacagcctacatggagttgaggagcctgacatctgacgacaccggccgtctattactgtgcgagagtcccacgatccggtgagcctacggcagcggcctttgacttctc

SEQ ID NO: 530874 - DNA, 506 bp, Homo sapiens
  misc_feature: HEFZJCU01BZOF9.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtattccggggggacgacatgactacc

SEQ ID NO: 530875 - DNA, 499 bp, Homo sapiens
  misc_feature: HEFZJCU01DD6HA.5.70.G04.1.454.heavy.3.raw
atcagacacgcacgaccggtgctcgatttagtgtagtgtgaagggaaagggggggagaggagccccagccctgagattcccaggtgtttccattcagtgatcagcactgaacacagaggactcaccatggagttgggactgaactggattttccttttggctatgttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgctcaccatctccagagacaacgccaagaactccctgtatctacaaatgaacagtctgagagttgaggacacggccttctattactgtgcaaaagatacgggacgaagtggtggtgg

SEQ ID NO: 530876 - DNA, 505 bp, Homo sapiens
  misc_feature: HEFZJCU01CN4G8.53.81.H04.1.454.heavy.3.raw
cgcgtatacacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaaatgaacagcctgagagctgaggacacggctctttattactgtgcgagaggatttctaggatacagccaatttta

SEQ ID NO: 530877 - DNA, 485 bp, Homo sapiens
  misc_feature: HEFZJCU01ELQI6.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctgggtggacagatcactggggccagggaaccctggtcaccgtctcctcagcctccaccaagggcccatcggtcttccccctggcgccctgctccaggagcacctccgagagcacagcggccctcgggctgcctggtcaaggactaccgttcccacgagagta

SEQ ID NO: 530878 - DNA, 524 bp, Homo sapiens
  misc_feature: HEFZJCU01ERFGX.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgagatgcagctgttggagtccgggggaggcttggtacagccgggggggtccctgacactctcctgtgcagcctcaggattcatttttagcgaatatgccatgagctgggtccgccaggctccagggaagggctggagtgggtctcagcaatcagtggtctagtggaagtacattcgacgccgtctccgtgaagggccggttctccatctccagagacaattccaagaacactctatttcttacaaatggacagcctgaaagacgaagacgacgggcgtgtatttttgtgttgaaagatacgaagtctatgactacccaaatttggggaggggtcctttc

SEQ ID NO: 530879 - DNA, 497 bp, Homo sapiens
  misc_feature: HEFZJCU01AVWZ8.49.23.C01.1.454.heavy.3.raw
agtcgagagacacgaccggtgctcgatttagtacacgtgattagggattggggacacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaagggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtatagcattatgctt

SEQ ID NO: 530880 - DNA, 534 bp, Homo sapiens
  misc_feature: HEFZJCU01AHN69.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccggtctcctcagccctccacccaagggcccatcggtcttcccctggcgccctgctccaggagcacctccgagagcgacagccggccctggggtccg

SEQ ID NO: 530881 - DNA, 481 bp, Homo sapiens
  misc_feature: HEFZJCU01EA2K3.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcaccctccgagagcacagccggcctgggctgcctggtcaaggactacttccagacgtatca

SEQ ID NO: 530882 - DNA, 529 bp, Homo sapiens
  misc_feature: HEFZJCU01D2DB7.16.27.C05.1.454.heavy.3.raw
  modified_base (429)..(429): a, c, t, g, unknown or other
  modified_base (472)..(472): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtggtggcgtttatttcatatgatggaactactcaacactatccagactccggggagggccgattcaccgtctccagagacattccaagaacagggtgtttctccaagtnattgatctgagaagtgaggacacggctgtttattactgtgcgnggtgctgaccgctcttgactcgtggggggccggggacggccccggtcactcgtctcc

SEQ ID NO: 530883 - DNA, 518 bp, Homo sapiens
  misc_feature: HEFZJCU01EEP3O.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcaccctggtcactgtctcctcggcttccaccaagggcccatccggtcttccccctggccgccctgctccaggagcacctctcggggcacgacgcggcccg

SEQ ID NO: 530884 - DNA, 493 bp, Homo sapiens
  misc_feature: HEFZJCU01B2YJI.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccagggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgt

SEQ ID NO: 530885 - DNA, 527 bp, Homo sapiens
  misc_feature: HEFZJCU01BPRA7.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccgggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcgggaccaccgccatatattactgtgcgagtccggttatcgccgcagatcactactacttactacggtctgggacgtcgtggggaccaaggggacccg

SEQ ID NO: 530886 - DNA, 510 bp, Homo sapiens
  misc_feature: HEFZJCU01C3TKO.2.33.C11.1.454.heavy.3.raw
acgctcgacacacgaccggtgctcgatttagagtgagctcgtgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcgttcaggagatgaatcacagagcactctgtttctgcaaatgaacagcctggaagacgcggacacagccatgtattattgtacattaggacactaatacgtcccgtggggcccaaggggtaa

SEQ ID NO: 530887 - DNA, 551 bp, Homo sapiens
  misc_feature: HEFZJCU01A0BUN.49.34.D01.1.454.heavy.3.raw
agtcgagagacacgaccggtgctcgatttagatcgtctgtgttgggtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacggcatggacgtcgtggggccaagggaccccggtcaccgtctccttagcctccaccaacgggcccagtccggtcttccccccgttcggccgacccctccctccctaagagcaccctctc

SEQ ID NO: 530888 - DNA, 516 bp, Homo sapiens
  misc_feature: HEFZJCU01DMJBS.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggccaccctcctccaagacgcacctctgggggcacagcggcctggctgcctggtcaaggactacttccagacgta

SEQ ID NO: 530889 - DNA, 542 bp, Homo sapiens
  misc_feature: HEFZJCU01DSOQA.48.14.B03.1.454.heavy.3.raw
agtatacatacacgaccggtgctcgatttagtgtgagtagttccgcgggggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctggggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcacccatctacagagacaacggcaaggaagtcgctgtttctgcaatgaacagcctgacctccgacgacacggctctctattattgtgtgagagaatcctggggaccggccgtcgttcgggggccaggggaacactggttatcgtctcttctacg

SEQ ID NO: 530890 - DNA, 525 bp, Homo sapiens
  misc_feature: HEFZJCU01B2IZB.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacgggccttatatttctgtgcgagagccctcggcagaagtctggactactactattatggtatggacgtctggggccaagggaccacggtcatcgtctcctctagcctccaccaagggcccatccggtcttcccctggcaccctcctccaagagcacctctgggggcacgagcc

SEQ ID NO: 530891 - DNA, 495 bp, Homo sapiens
  misc_feature: HEFZJCU01BH91F.48.77.G11.1.454.heavy.3.raw
agtatacatacacgaccggtgctcgatttagctagtcactcaagggaaaggggctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgagggctggaagacacggctgtgtattactgtgcgagaggctatcactatt

SEQ ID NO: 530892 - DNA, 518 bp, Homo sapiens
  misc_feature: HEFZJCU01BTJU3.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtggggtggccaacataaacaaagacggaagtcagaaaactatgtggactctgtgaacggccgattcaccatctccagagacaacgccaagaattacactgtatttgcaaatgaacagcctgagaggcgaggacacggccgtgttattattgtgcgcgagatgatagtagaactctacagtacgcgaggtggta

SEQ ID NO: 530893 - DNA, 512 bp, Homo sapiens; identical to SEQ ID NO: 447361
  misc_feature: HEFZJCU01EJYMY.7.28.C06.1.454.heavy.3.raw

SEQ ID NO: 530894 - DNA, 518 bp, Homo sapiens
  misc_feature: HEFZJCU01DNGT7.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagactatgtggactctgtgaagggccattcaccatctccagagacaacgccaagaactcactgtatctgcaaatgaacagcctaaaaaggcccgaggaccacggctgtgtattactgtcgcgagacgaccgactacgtcggggcccggagcccgtggtcc

SEQ ID NO: 530895 - DNA, 517 bp, Homo sapiens
  misc_feature: HEFZJCU01EMFAU.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggccccctggacaagggcttgagtggatgggatggatcagcgcttacaatgggaacacaaactatgcacagacgttccagggcagagtcaccattaccacagacacatccacgagcacagcctaacatggaccctgaggagcctgagtatttgacggacacggccatatattactgtgcgagagattgggccgacgggaaccttgactacgtggggccagggaaccctggtcaccgt

SEQ ID NO: 530896 - DNA, 400 bp, Homo sapiens
  misc_feature: HEFZJCU01DARCN.47.24.C02.1.454.heavy.3.raw
agctcacgtacacgaccggtgctcgatttagtacagatcgttagggaaagggactggagtggattggctatgttcattccagtgggagcaccgactataacctctctctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 530897 - DNA, 487 bp, Homo sapiens
  misc_feature: HEFZJCU01DQAJO.3.75.G09.1.454.heavy.3.raw
  modified_base (416)..(416): a, c, t, g, unknown or other
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcagtgaatagcctgagacgtgacgacacggctgtntattactgtgcgagagagggttcgcagctcgtccggcgggccctagttgaacatgactactcactacgtac

SEQ ID NO: 530898 - DNA, 510 bp, Homo sapiens
  misc_feature: HEFZJCU01DTTEV.13.37.D04.1.454.heavy.3.raw
  modified_base (453)..(453): a, c, t, g, unknown or other
  modified_base (478)..(478): a, c, t, g, unknown or other
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctggggaanccggagaccgacggtccgttttaanctactgtgcgaaagatattgtaatgagtggta

SEQ ID NO: 530899 - DNA, 481 bp, Homo sapiens
  misc_feature: HEFZJCU01D8I5Q.11.63.F08.1.454.heavy.3.raw
cgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcaggctgacatctagacgacacggccgtgtattactgtgcgagagagtaaaggggattgtgatagta

SEQ ID NO: 530900 - DNA, 528 bp, Homo sapiens
  misc_feature: HEFZJCU01BSS3V.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccgagggaacccgtggtcaccgtctcctcagcctccaccaagggcccatcggtcttcccctggccgccctgctccaggagcacctccgacgagccacagcgggccctcgggctcgcctggtccaaaggaccgtactttaccg

SEQ ID NO: 530901 - DNA, 504 bp, Homo sapiens
  misc_feature: HEFZJCU01BJIW7.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaccaggtggtccttacaatgaccaacatggaccctgtggacacagccacactattactgtgcacagagatacgggcagcacgtgggtttggggctacgtggggccagggaacccgtggtccaccgtctccctcacgccgtccaaccg

SEQ ID NO: 530902 - DNA, 504 bp, Homo sapiens
  misc_feature: HEFZJCU01EW4YB.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagtgtgtggtatgacggaagtaatagaaagtatgccgacgccgtggaagggccgattcaccatctccagagacaattccaacaacatgttgtatctgcaaatgaatagcctgagaggccgaggacacggctgtgtattactgtgttcagagatgggaggggggtggtggatcc

SEQ ID NO: 530903 - DNA, 487 bp, Homo sapiens
  misc_feature: HEFZJCU01AYXVJ.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctagtatggagatgaggagccgtgagacttgacgacacggccgtatacttactcgtgcgagaatcgagaaggtggctac

SEQ ID NO: 530904 - DNA, 496 bp, Homo sapiens
  misc_feature: HEFZJCU01CTZQG.14.25.C03.1.454.heavy.3.raw
  modified_base (441)..(441): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccgggcgaggggctggagtgggtggcgattatatcacatgatggaactaatagacgctatgccgactccgtgaagggccgattcaccatctccagagacaattccaagaacacgcagtatctgcaaatgaacagcctgagngctgaggacacggctgtgtattactggtggagagagtggaggtcgatattgtagt

SEQ ID NO: 530905 - DNA, 515 bp, Homo sapiens
  misc_feature: HEFZJCU01BDQ28.3.34.D01.1.454.heavy.3.raw
  modified_base (453)..(453): a, c, t, g, unknown or other
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacgggtcatcgtctccgcagcctccaccaagggcccatcggtcttccccctggcaccctcctccaanagcacctctgggggcacagcggccctgggctgcctggtcaaggactacttccgagtgcgtct

SEQ ID NO: 530906 - DNA, 545 bp, Homo sapiens
  misc_feature: HEFZJCU01BX9K0.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaggtgtccagtgtgaggtgcagttggtggactctgggggagacctgataccgcctggggggtccctgagactctcctgtacagcctctggattcacctttaggagccatgccatgagctgggtccgccaggctccagggaagggctggagtgggtctctactattactgctagtggtaatcatgcatactatgcagactccgtgaagggccggttcaccttcaccagagacaattccaagacacgctctatctgcaattgaccagcctgagcgccgaggacaccggccatgtattactgtactaaatcgtcgggtggccggcggccgggtaccgtcggtacttgggtttttgtacttttgtcgggggtccgaaggggtaaacg

SEQ ID NO: 530907 - DNA, 508 bp, Homo sapiens
  misc_feature: HEFZJCU01DZEYG.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggg

SEQ ID NO: 530908 - DNA, 512 bp, Homo sapiens; identical to SEQ ID NO: 489416
  misc_feature: HEFZJCU01CQE04.16.21.B10.1.454.heavy.3.raw

SEQ ID NO: 530909 - DNA, 485 bp, Homo sapiens
  misc_feature: HEFZJCU01DC4DC.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagacgcacagcggccctggggctgcctggtcaaggactacttcctacgtgagct

SEQ ID NO: 530910 - DNA, 516 bp, Homo sapiens
  misc_feature: HEFZJCU01EY7TG.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactagttcacgctctatggttcggggagttattagtccctactttgactactggggccagggaactctggtcaccgtctccgcagcctccaccaacgggccca

SEQ ID NO: 530911 - DNA, 477 bp, Homo sapiens
  misc_feature: HEFZJCU01BY23G.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactccgaggacgacgggtgtatattactgtggaagaggcccc

SEQ ID NO: 530912 - DNA, 516 bp, Homo sapiens
  misc_feature: HEFZJCU01EFJ7T.48.12.B01.1.454.heavy.3.raw
  modified_base (460)..(460): a, c, t, g, unknown or other
  modified_base (479)..(479): a, c, t, g, unknown or other
agtatacatacacgaccggtgctcgatttagtagtgtagatttgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcgggcctggacgaacgtcgacggactacggaccattactactntgcgcggggagtggacggngcgtcggttttcggagttatcatctactctttacggt

SEQ ID NO: 530913 - DNA, 526 bp, Homo sapiens
  misc_feature: HEFZJCU01A3P1O.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccaggggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcggagagacccctcgatagcagtggctggtccactaggtttgactacgtcgggggccaggggaagcgtttgggtccaccggtctccctt

SEQ ID NO: 530914 - DNA, 536 bp, Homo sapiens
  misc_feature: HEFZJCU01BYUA5.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggtcctttcatgtctggggccaagggacgctggtcaccgtctcttcagcctccaccaagggccatcggtcttcccctggccaccctcctccaagagcacctcgtgggggcac

SEQ ID NO: 530915 - DNA, 493 bp, Homo sapiens
  misc_feature: HEFZJCU01C68YV.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgacttcaccatctccagagacaattcccagaacacggtctatctgcacctgaccagcctgagaactgacgacacgtctctctactactgtgcgagagagttgacgagta

SEQ ID NO: 530916 - DNA, 488 bp, Homo sapiens
  misc_feature: HEFZJCU01ECNHQ.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccagggccatcggtcttcccctggcaccctcctccaagagcacctctgggggcacagcggccctgggctgcctggtcaaggactactccgagtgcgtct

SEQ ID NO: 530917 - DNA, 521 bp, Homo sapiens
  misc_feature: HEFZJCU01EIE4Y.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggacgagcgggagtccaagtactctttgacgtcgtc

SEQ ID NO: 530918 - DNA, 504 bp, Homo sapiens
  misc_feature: HEFZJCU01DOM76.48.30.C08.1.454.heavy.3.raw
agtatacatacacgaccggtgctcgatttagtctgacgtcaaagggaaaggggagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacaggcccctcgacaagggcctgagtggatggggatgatcaaccctaggtatggcagcacaagccacgcagagaagttccagggcagagttatcatgaccagcgacacgtccaccgagcacagtctacatgagttcgtgagcagcctgagatctgaagacgacggccgttctatttactggttcgcggacggaggggggggtcgggggtcccgtaaacgg

SEQ ID NO: 530919 - DNA, 483 bp, Homo sapiens; identical to SEQ ID NO: 462753
  misc_feature: HEFZJCU01BGQDX.19.13.B02.1.454.heavy.3.raw

SEQ ID NO: 530920 - DNA, 496 bp, Homo sapiens
  misc_feature: HEFZJCU01AJ8NO.40.22.B11.1.454.heavy.3.raw
tctagcgactcacgaccggtgctcgatttagacgacagctcagggggctctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctgggggggtccctgagactctcctgtgcagcctctggattcaccttcagtagctatagcatgaactgggtccgccaggctccagggaaggggctgggagtgggtttcatacattagtagtagtagtagtaccatatactacgcagactctgtgaagggccgattcaccatctccagagacaatgccaagaactcactgtatctgcaaatgaacagcctgagagacggaggaccacggctgtatattaactgtgcgagagagccaggtggctaac

SEQ ID NO: 530921 - DNA, 510 bp, Homo sapiens
  misc_feature: HEFZJCU01DINZI.11.6.A06.1.454.heavy.3.raw
cgagagataccacgaccggtgctcgatttagatctactgacaggggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtggaagggcagattccaccatctccagagatgattcaaggagcacagtgtttctacaaatgaacagcctgactgccgggggacactgccgtgtattactgtgccagcagcagcaccgtggccactatattttcttt

SEQ ID NO: 530922 - DNA, 519 bp, Homo sapiens
  misc_feature: HEFZJCU01C0Z17.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccaggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggccccacggaacgttactacgctatcggacgtcgtggggacccg

SEQ ID NO: 530923 - DNA, 528 bp, Homo sapiens
  misc_feature: HEFZJCU01DX1QW.51.86.H09.1.454.heavy.3.raw
cgatcgtatacacgaccggtgctcgatttagtgctatagacttgggtttgggctatagacttgggtttggggggaagaggaagactgacggtcctcccaggtgtccagtgtcaggtgcagctggtggactctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagagctgaggacacggcttctttttactgttgcgccaggaagcagtggctggccacatgatgtcttttgattatctggtaggccgaaagggacaaatggttcagtcgtctccgtttccggtccctccctacccgaacgggaccccacgtccgggttccc

SEQ ID NO: 530924 - DNA, 498 bp, Homo sapiens
  misc_feature: HEFZJCU01EAOA2.47.55.E11.1.454.heavy.3.raw
  modified_base (458)..(458): a, c, t, g, unknown or other
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctntcattgtgttttcgatgccgttcggtccggcgggactttc

SEQ ID NO: 530925 - DNA, 497 bp, Homo sapiens
  misc_feature: HEFZJCU01DEJ0J.11.71.G05.1.454.heavy.3.raw
cgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactcccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctagtagaggt

SEQ ID NO: 530926 - DNA, 508 bp, Homo sapiens
  misc_feature: HEFZJCU01BP4JV.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagactccgggtgacgcctacggcagccggcctttgacctttctc

SEQ ID NO: 530927 - DNA, 527 bp, Homo sapiens
  misc_feature: HEFZJCU01AQ8WX.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggctttattactgtgcgagagggacggactacggtgactactgggggttcgaccccgtggggccagggaaccctggtcaccgtctcctcacgcctccaccg

SEQ ID NO: 530928 - DNA, 465 bp, Homo sapiens
  misc_feature: HEFZJCU01BINUT.48.7.A07.1.454.heavy.3.raw
agtatacatacacgaccggtgctcgatttagcacgtgtcgcaggggcagggtgtacacctgtggttctcggggctgtcctttggttttggagatggttttctcgatggggactgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaaggcccatcggtcttcccctggcgccctgctccaggagcacctctgggggcacagcggccctgggctgcctggtcaaggactacttcctatgtatact

SEQ ID NO: 530929 - DNA, 526 bp, Homo sapiens
  misc_feature: HEFZJCU01EG548.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcagcagtcgagtcaccttttcgcttgacacgtccaacaaccagttttctctgaatacaaaaccccgagaccgccgcggacagcctcggcccctggggccccagaaaccccg

SEQ ID NO: 530930 - DNA, 486 bp, Homo sapiens
  misc_feature: HEFZJCU01A30MF.48.38.D05.1.454.heavy.3.raw
agtatacatacacgaccggtgctcgatttagtatctgatagttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggttggataaagccacgagcacagtctacatgcagctgagcagcctgagacacaacgacacggccgtctattattgttccagagataatcgcgtgaataagatatc

SEQ ID NO: 530931 - DNA, 503 bp, Homo sapiens
  misc_feature: HEFZJCU01D50YQ.14.25.C03.1.454.heavy.3.raw
  modified_base (463)..(463): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcacctttcagtacctatgcttatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtnttatacgtgttggggagagaagtggaggtcggatattgta

SEQ ID NO: 530932 - DNA, 508 bp, Homo sapiens
  misc_feature: HEFZJCU01ELBDP.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttatttatagtagtggtagtacatactccgcagactccgtgagggccgattcaccatctccagagacaattccaagaacacgctgtttctcaaatgaacagcctgagagccgatgacacggccgtgtattactgtgcgagagagtggggcccacgaaccgttactacgtctatggacgtcgt

SEQ ID NO: 530933 - DNA, 498 bp, Homo sapiens
  misc_feature: HEFZJCU01COABF.4.7.A07.1.454.heavy.3.raw
  modified_base (476)..(476): a, c, t, g, unknown or other
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggtccggttctccatctccagagacaattccaaagacacgctgtatctgcaattgaacagcctgagagccggagacacggccgtatattactgtgacgaaagngtttaggggaatcgaccacgtc

SEQ ID NO: 530934 - DNA, 502 bp, Homo sapiens
  misc_feature: HEFZJCU01AHBFY.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctgggccagggaaccctggtcaccgtctcctcagcctccaccaagggcccatcggtcttcccctggcgccctgctccaggagcacctccgagagcacagcgccctgggctgcctggtcaaggactacttccagacgtatca

SEQ ID NO: 530935 - DNA, 530 bp, Homo sapiens
  misc_feature: HEFZJCU01C742W.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaagggctggagtgggtctctggtctgaattggaatggtgatagtatagattatgcaggctctgtgaggggccgattcaccatctccagagacaacgccaagaactccctgtttcacaaatggacaatttgagagaggaagacacggccttagtatttctgtgcgagagccctcggcagaagtctggactactaactattatggtatggacgtcgtggggtaccg

SEQ ID NO: 530936 - DNA, 477 bp, Homo sapiens
  misc_feature: HEFZJCU01ETBRV.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcgagggtcaccatgaccagggacacgtccatcagcacgtccatcagcacagcctacatggacctggagcggcctgacaatctgacgacacggtccgtattatttctgt

SEQ ID NO: 530937 - DNA, 539 bp, Homo sapiens
  misc_feature: HEFZJCU01BY5UH.49.67.G01.1.454.heavy.3.raw
agtcgagagacacgaccggtgctcgatttagagtatacatattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacgggtcgtcatggggacttttggacttacgtgggggacccaggggtaacccccggtcaacccgttctccctctggtccct

SEQ ID NO: 530938 - DNA, 372 bp, Homo sapiens; identical to SEQ ID NO: 444727
  misc_feature: HEFZJCU01CQIBJ.3.42.D09.1.454.heavy.3.raw

SEQ ID NO: 530939 - DNA, 496 bp, Homo sapiens
  misc_feature: HEFZJCU01BRTGY.53.62.F07.1.454.heavy.3.raw
cgcgtatacacacgaccggtgctcgatttagtagtcgcataaagggaaaggggtagtcgcataaagggaaagggggaggtgtgtcacaagatttgggctctgggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggagcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcacatctccagagacaattccaagaacacactgtatctgcaaatggacagtctgagaactgaa

SEQ ID NO: 530940 - DNA, 501 bp, Homo sapiens
  misc_feature: HEFZJCU01EBODP.13.67.G01.1.454.heavy.3.raw
tcacgtactacacgaccggtgctcgatttagagtatacatattgggtctgggggaggcttggtacagcctggaaggtccctgagactctcctgtgcagcctctggattcacctttagcagctatgccatgacctgggtccgccaggctccagggaaggggctggcgtgggtctcaggtattagtggtagtggtggaagcacatactacgcagactccgtgaagggccggttcaccatctccagagacaattccaagaacacgctgtatctgcaaatgaacagcctgagagccgaggacacggccgtatattactgtgcagcagtggctggcacaggagcatattactttgactactggggccagggaaccctggtcaccgtctcctcagcctccaccaacgggcccatcggtcttccccgtggccaccctcctccaagagcacctctgggggcacagcggcccgtgggctgcctggtcaaggactacttcctagtacgtga

SEQ ID NO: 530941 - DNA, 487 bp, Homo sapiens; identical to SEQ ID NO: 458685
  misc_feature: HEFZJCU01DBL4T.22.86.H09.1.454.heavy.3.raw

SEQ ID NO: 530942 - DNA, 512 bp, Homo sapiens
  misc_feature: HEFZJCU01CSD0C.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactgggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtaggtgggggtacttgcaacccgggatactactccaccttcggcttgacatctgggccg

SEQ ID NO: 530943 - DNA, 522 bp, Homo sapiens
  misc_feature: HEFZJCU01CID3K.40.55.E11.1.454.heavy.3.raw
tctagcgactcacgaccggtgctcgatttagcactcgcacgttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcacgacacggctgtctattactgtgcgaggcccgagcgcagtggtcgtttttgatgtcctttgtatagtgtgggggaccgaacggggaacgaagtaggtctaccgttcc

SEQ ID NO: 530944 - DNA, 563 bp, Homo sapiens
  misc_feature: HEFZJCU01DUI4Q.17.28.C06.1.454.heavy.3.raw
  modified_base (456)..(456): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgnagacacggccgtgtattactgtgcggagatgtgggaaaaagtaagtacgggcttggttgtttagttttggggggacccaggggggaggtccccgtgggttccgaccc

SEQ ID NO: 530945 - DNA, 502 bp, Homo sapiens
  misc_feature: HEFZJCU01CJPTW.51.23.C01.1.454.heavy.3.raw
  modified_base (492)..(492): a, c, t, g, unknown or other
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggcccgttttattacctgtgcgagatttaccggtgggggtcaggcggatntatcgccata

SEQ ID NO: 530946 - DNA, 502 bp, Homo sapiens
  misc_feature: HEFZJCU01B1LGB.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagacgcacagcggcccgtgggctgcctggtcaaggactacttcctacgtcgtat

SEQ ID NO: 530947 - DNA, 505 bp, Homo sapiens
  misc_feature: HEFZJCU01A20N3.48.81.H04.1.454.heavy.3.raw
  modified_base (463)..(463): a, c, t, g, unknown or other
agtatacatacacgaccggtgctcgatttagtagtgtagattcgcgggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatcctttctctaatgtcacaagatacacacagagattccagggcagaatcacacttaccgcggacaaatccacgggcacagcgcagttggacctgagcggcctgagacctgaggacacggcatttactactgtgcgcggggnggtggacggagctcggttttcggagttatcatctactacttt

SEQ ID NO: 530948 - DNA, 526 bp, Homo sapiens
  misc_feature: HEFZJCU01DVS90.3.52.E08.1.454.heavy.3.raw
agacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtc

SEQ ID NO: 530949 - DNA, 545 bp, Homo sapiens
  misc_feature: HEFZJCU01BMIX0.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaacgggcccatcggtcttcccccgtggccaccctcctccaagacgccacctcgtcgggggcacagcc

SEQ ID NO: 530950 - DNA, 515 bp, Homo sapiens
  misc_feature: HEFZJCU01A6S3Y.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctaactatttggactctgtgaggggccgattcatcatctccagagacaacgccgacaactcactgtctctgctgatgagcagcctgagagccgacgacacggctatctatactgtgcgaaactctcacttccgttctatctgaatacgtgggccacgggaaccctggtccgtccg

SEQ ID NO: 530951 - DNA, 514 bp, Homo sapiens
  misc_feature: HEFZJCU01DMCF4.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctatttttgtccggttggttcgcccgtggggccagggaaccctggtcaccgtctcctc

SEQ ID NO: 530952 - DNA, 538 bp, Homo sapiens
  misc_feature: HEFZJCU01BXYS7.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaatgaacagcctgagaaccgaggacacagccgtgtattactcgtaccgacactcccctgaaacgcgtacaactactactactacggtatcggacctcg

SEQ ID NO: 530953 - DNA, 503 bp, Homo sapiens
  misc_feature: HEFZJCU01DZFZD.4.7.A07.1.454.heavy.3.raw
agcactgtagcacgaccggtgctcgatttagcacgtgtcgcaggggctgagagaggagcccagccctgggattttcaggtgtttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctggggtcccgccaggcctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtataattactagtgacgaaagatttagggggaatggaccacgtc

SEQ ID NO: 530954 - DNA, 535 bp, Homo sapiens
  misc_feature: HEFZJCU01AF6M7.52.73.G07.1.454.heavy.3.raw
  modified_base (521)..(521): a, c, t, g, unknown or other
cgcagtacgacacgaccggtgctcgatttagctctacgctcagggggctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaactacgccctggcgctatggacgtctggggccagggaccacggtcaccgtctcctcagcctccaccaacgggcccancggtcttcccctgg

SEQ ID NO: 530955 - DNA, 529 bp, Homo sapiens
  misc_feature: HEFZJCU01EFRQZ.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcgaccatctccagagacaattccaagaacacggtgtatcttcaaatgaacagcctgagagccgatgacacggccgtgtattactgtgtgagatcaaattccaagccgcgggggtcacccaaattgactactgggccagggaaccctggtcaccgtctccctcacgcctccaccaagggcccatcggtcttccccctcggccgccctcgctccac

SEQ ID NO: 530956 - DNA, 533 bp, Homo sapiens
  misc_feature: HEFZJCU01DFMJ0.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatgggcagtgttataaattatgcggactccgtgaggggccgattcagcatctccagagacaacggcaagagtatactgtatctggaatagaacaatctgacgagtcgagataacggctgtctatctattgttgtttttacgagttgcccttcggtcccggcggggtacctttcgtcggggccgacggggtaacccttc

SEQ ID NO: 530957 - DNA, 529 bp, Homo sapiens
  misc_feature: HEFZJCU01C2C10.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggcaatactatgggggcttgttctgggggccagggggaccctggtcatcgtctcccacgcctccaccagggcccatccggtcttcccctggccgccctcg

SEQ ID NO: 530958 - DNA, 507 bp, Homo sapiens
  misc_feature: HEFZJCU01A0REZ.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggtattcaccttcagtagctatagcatgaactgggtccgccaggctccagggaagggctggagtgggtctcatccattagtagtagtagtagttacatatactacgcagactcagtgaagggccgattcacatctccagagacaacgccaagaactcactgtatctgcaaatgaacagcctgagagccggaggacacggctgtgtattactgtgcgtagttttggttggggcgggtatgcaggcgggaccc

SEQ ID NO: 530959 - DNA, 524 bp, Homo sapiens
  misc_feature: HEFZJCU01BRGNV.53.64.F09.1.454.heavy.3.raw
cgcgtatacacacgaccggtgctcgatttagcgcgtatacaaggggagctctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagaagacgaccgctggacgaggagccagaggaaaatcactactttgacc

SEQ ID NO: 530960 - DNA, 512 bp, Homo sapiens
  misc_feature: HEFZJCU01E11L3.49.53.E09.1.454.heavy.3.raw
agtcgagagacacgaccggtgctcgatttagagagagtgtgttgggtttggggttgaagtgaagaagcctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgagagtcactcattactacgatagttatggtgactatccttttgatatctggggccaagggacactggtcaccgtctcttcagcttccaccaagggcccatcggtcttcccctggcgccctgctccaggagcacctctgggggcacgagcggccctcgggctgcctggtcaagggactacttcctctctcgact

SEQ ID NO: 530961 - DNA, 489 bp, Homo sapiens
  misc_feature: HEFZJCU01BVJP4.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggccatcggtcttcccctggcgccctgctccaggagcacctccgagagcacagcggccctgggctgcctggtcaggactacttccgtatctctcg

SEQ ID NO: 530962 - DNA, 517 bp, Homo sapiens
  misc_feature: HEFZJCU01C9VTA.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccgggagtggggtgtcagtcattagtagtaggtggtgatagaatttaccacacagactccgtgaagggccgcttcacccatctctagagacaattcccagaaacacactgtatctgcaaaatgactaggctgagagccgacgacacggccatttattactgcgcgaaggatatacgggtcgacaacggtggctacgcgtttct

SEQ ID NO: 530963 - DNA, 515 bp, Homo sapiens
  misc_feature: HEFZJCU01A47M7.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccaggggaaggggctggagtggggttggccgttctagagacacaactaacagtagacaccgcacaatacgccgcgtctgtgaaaggcagattcaccatctcaagagatgattcagagaactcactttatctgacaaatgaacagcctgaagaaccgacgaccacggccgtctattattgtgtcataggacctaggatacgaacgac

SEQ ID NO: 530964 - DNA, 496 bp, Homo sapiens
  misc_feature: HEFZJCU01EL81X.13.85.H08.1.454.heavy.3.raw
  modified_base (463)..(463): a, c, t, g, unknown or other
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagtttgagcagcctgagatctgacgacacggccgttttattactgtgcgcgngataatagtcacactggaacggcgttttggggt

SEQ ID NO: 530965 - DNA, 415 bp, Homo sapiens
  misc_feature: HEFZJCU01BFZ3I.14.74.G08.1.454.heavy.3.raw
cgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctggggcacagcggccctgggcctgcctggtcaaggactacttccgtactagacg

SEQ ID NO: 530966 - DNA, 511 bp, Homo sapiens
  misc_feature: HEFZJCU01EWWBM.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgcaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcacaacggtggctacgcgtttctag

SEQ ID NO: 530967 - DNA, 465 bp, Homo sapiens
  misc_feature: HEFZJCU01A4YAI.18.33.C11.1.454.heavy.3.raw
  modified_base (249)..(249): a, c, t, g, unknown or other
  modified_base (283)..(283): a, c, t, g, unknown or other
  modified_base (430)..(430): a, c, t, g, unknown or other
tacgagtatgcacgaccggtgctcgattagagtgagctcgttgggtttgggggggagaggagcccagcactgggattccgaggtgtttccattcggtgatcagcactgaacacagaggactcaccatggagttttggctgagctgggttttccttggttgctatttcaaaaggtgtccagtgtgaggtgcagttggtggagactggaggaggcttgatccagcctggggggtccctgagactctcctgngtcagtctctgggttcgtcagtggcgactacatnagcgtgggtcccgccaggcttcccaggggaacgggtccctgggagtggatctcaactttattataggtggtcggtaaccactattaacctacaccagaccgttccgtaggaaacgggccgtaattccaaccattcctccaaggtaanactaaacttcccgaaggtaaccacttaagttctaa

SEQ ID NO: 530968 - DNA, 512 bp, Homo sapiens
  misc_feature: HEFZJCU01BZCML.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggtccgattcaccatctccagagacaacgccaagaattcactgtatttgcaaatgaacagcctgagaggcgaggacacggccgtgtattattgtgcgcgagatgatagtagactctacagtagcaggtgta

SEQ ID NO: 530969 - DNA, 526 bp, Homo sapiens
  misc_feature: HEFZJCU01A16LP.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccgagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgtgaaagatacgagtctatgatacccaatttggggagggtcctttcatgtctc

SEQ ID NO: 530970 - DNA, 507 bp, Homo sapiens
  misc_feature: HEFZJCU01EI884.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctagaggagcctgagatttgacgacacggccatatattactgtgcgagagattgggccgacggaaaccttgactacgtcggggccacggggaaccct

SEQ ID NO: 530971 - DNA, 536 bp, Homo sapiens
  misc_feature: HEFZJCU01EPO9Q.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccaggggagcccctggtcacg

SEQ ID NO: 530972 - DNA, 518 bp, Homo sapiens
  misc_feature: HEFZJCU01EA1RV.15.23.C01.1.454.heavy.3.raw
  modified_base (443)..(443): a, c, t, g, unknown or other
  modified_base (499)..(499): a, c, t, g, unknown or other
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagtaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaaacngcctgagagccgaggacacggccgtgtattactgtgtgagagacatgacaacggtnagtaaccgggaggggtttg

SEQ ID NO: 530973 - DNA, 508 bp, Homo sapiens
  misc_feature: HEFZJCU01EB7DP.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccaggggacg

SEQ ID NO: 530974 - DNA, 533 bp, Homo sapiens
  misc_feature: HEFZJCU01AVDSK.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgaccacggccgtgtattactgtgcgagagagtggggcccacgtaacgttactacgctatggacgtactcgggaccgaaggggacctac

SEQ ID NO: 530975 - DNA, 500 bp, Homo sapiens
  misc_feature: HEFZJCU01BJDFI.11.71.G05.1.454.heavy.3.raw
  modified_base (449)..(449): a, c, t, g, unknown or other
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctganagctgaggacacggctgtgtattaactgtggacgaaaggtatttcgtataa

SEQ ID NO: 530976 - DNA, 524 bp, Homo sapiens
  misc_feature: HEFZJCU01ALZCL.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtcgaccccgtggggccagggaaccctggtccaccgtctcctcacgt

SEQ ID NO: 530977 - DNA, 482 bp, Homo sapiens
  misc_feature: HEFZJCU01A4TE9.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagatcgagaaggtggctac

SEQ ID NO: 530978 - DNA, 523 bp, Homo sapiens
  misc_feature: HEFZJCU01B01CT.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttaatctgcaaatagacagcctgagaccagacgacacgggctgtctattattgcgcgagagagacacacgaacctactggccaatactatgggggcttggttctggggccaggggaccctgggtcatcgtctccccagcctccaccaacggccatcggtctcccctggcg

SEQ ID NO: 530979 - DNA, 516 bp, Homo sapiens
  misc_feature: HEFZJCU01CLXI9.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacagtatgtagactctgtggagggccggttcaccatctccagagacaacgccaagaatgcgaatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccagagcacctccgagagcacacgcggccctcgggctc

SEQ ID NO: 530980 - DNA, 458 bp, Homo sapiens
  misc_feature: HEFZJCU01ATPNF.15.28.C06.1.454.heavy.3.raw
tctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggcgccctgcctccaggagcacctccgagagcacagcggccctgggctgcctggtcaaggactacttccgctacgtaga

SEQ ID NO: 530981 - DNA, 521 bp, Homo sapiens
  misc_feature: HEFZJCU01DFOSO.18.85.H08.1.454.heavy.3.raw
  modified_base (458)..(458): a, c, t, g, unknown or other
  modified_base (518)..(518): a, c, t, g, unknown or other
tacgagtatgcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcagtttcagtgcctactggatgcactggatccgccaagttccagggaagagactggtgtgggtctcacgtattaaagatgatgggggtgccacatcctacgcggactccgtgaggggccgcttcaccatctcccgagacaacaccaagaacacgctgtatctgcaaatgagcagtctgggagtcgaggacacggctgtctattactgtgcaaggaggggactacggngcctaggaggggttggtccgaccccgttggggcccagggaaccctggtcaccgtctcctnacg

SEQ ID NO: 530982 - DNA, 436 bp, Homo sapiens
  misc_feature: HEFZJCU01D0TBO.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcaccctcctccaagagcacctctgggggcacagcggccctggctgcctggtcaaggactacttccagtcgctaga

SEQ ID NO: 530983 - DNA, 513 bp, Homo sapiens
  misc_feature: HEFZJCU01ETKAX.51.36.D03.1.454.heavy.3.raw
cgatcgtatacacgaccggtgctcgatttagctgcgtcacgatctctcttggggatgctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacgcccccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggcctttgtatttctgtgctagatataatgtgggtgacagtgggtgccttactacggagtcttttgatagttttgggggccaaggccg

SEQ ID NO: 530984 - DNA, 513 bp, Homo sapiens
  misc_feature: HEFZJCU01DN9XI.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcaagaaaaactatgtggactctgtgaacggccgattcaccatctccagagacaacgccaagaattcactgtatttgcaaatgaacagcctgagaggcgaggacacggccgtgtattattgtgcgcgagatgatagtagactctaacagtagcagggtgt

SEQ ID NO: 530985 - DNA, 450 bp, Homo sapiens
  misc_feature: HEFZJCU01B53QY.51.37.D04.1.454.heavy.3.raw
cgatcgtatacacgaccggtgctcgatttagtagcatactgttgggtttggggttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcagggtccgggagatcatgagggtgtccttgggttttgggggaagaggaagactgaggtccccccaggagttcaggtgctgggcacagcggccctgggctgcctggtcaaggactacttcctcgtagcact

SEQ ID NO: 530986 - DNA, 500 bp, Homo sapiens
  misc_feature: HEFZJCU01CW2W5.53.4.A04.1.454.heavy.3.raw
cgcgtatacacacgaccggtgctcgatttagagtagtgatcagggggctctgggagacgagcccagcactggaagtcgccggtgtttccattcggtgatcatcactgaacacagaggactcaccatggagtttgggctgagctgggttttcctcgttgctgttttaagaggtgtccagtgtcaggtgcatctggtggagtctgggggaggcgtggtccagcctggggggtccctgagactctcctgtgcagcctctggattcaccttcagtacctatcctattcactgggtccgccaggctccgaggcaagggcctggagtgggtggcacttatatcatatgatgggaggtgataaatactacgcagactccgtgaagggccgattcgccatctccagagacaattccaagaacacccctctatctacaaatgaagagactgagacctgaggacacggctgtcttattactgtgcgagagtcggctttagagatgcctac

SEQ ID NO: 530987 - DNA, 500 bp, Homo sapiens
  misc_feature: HEFZJCU01C6A14.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaaagcaagtggtccttacaatgaccaacatggaccctttggacacagccacatattactgtgcacaccacagggtctctactgctggctttcagtacaactggttcgaaccctggggccagggaaccctggtcagcgtctacctcagcct

SEQ ID NO: 530988 - DNA, 492 bp, Homo sapiens
  misc_feature: HEFZJCU01EOR8T.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgaactgacaatcaacgtagacacatcgaagaaccagttctccctgcagctgacctctgtgactcccgaggtacacggggtgtatattaactgtggaaagacggccccatagactatgcccacctcgtctcctggtgctt

SEQ ID NO: 530989 - DNA, 519 bp, Homo sapiens
  misc_feature: HEFZJCU01CB5X8.4.33.C11.1.454.heavy.3.raw
agcactgtagcacgaccggtgctcgatttagagtgagctcgttggggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctggggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctgaagaccgaggacgacagccgtctattactgtgttagggtagttttacgtattttggtagtggatattaac

SEQ ID NO: 530990 - DNA, 537 bp, Homo sapiens
  misc_feature: HEFZJCU01DQNP9.10.85.H08.1.454.heavy.3.raw
catagtagtgcacgaccggtgctcgatttagtatcactcagtcgcggggggagaggagccttagccctggactccaaggcctctccacttggtgatcagcactgagcacagaggactcaccatggaattggggctgagctggggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagagtcactgtatctgacaaatgaacgatgtgagaggtcgaggacacggctgtatatttctgtgcggaggggagccggctagtgggttcggaccttcgtgggggaccaggggtaacccctggtacctacccg

SEQ ID NO: 530991 - DNA, 528 bp, Homo sapiens
  misc_feature: HEFZJCU01DGC9G.12.40.D07.1.454.heavy.3.raw
  modified_base (333)..(333): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagngacaattacaagaacaccctttatctgcaaatagacagcctgagaccagacgacacggctgtctattattgcgcgagagagacacacgaacctactggcccaatactatgggggtcttgtttctggggccacggggaccctgggtcatcgtctccccagcctccaccaacggcccatcggtcttccccgtggcgt

SEQ ID NO: 530992 - DNA, 510 bp, Homo sapiens
  misc_feature: HEFZJCU01DMSM1.17.25.C03.1.454.heavy.3.raw
  modified_base (405)..(405): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctanatggattggaggagcctggacatctgacgacacggccgttctattactgtgcgagacgtcccacgattccggtgagccctaggcagccggcctttggacttcgtc

SEQ ID NO: 530993 - DNA, 509 bp, Homo sapiens
  misc_feature: HEFZJCU01D18HE.3.63.F08.1.454.heavy.3.raw
  modified_base (431)..(431): a, c, t, g, unknown or other
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcattgaactgggtccgccaggctccagggaaggggctggagtgggtctcatccattagtagtagtagtagttacatatactacgcagactcagtgaagggccgaattcaccatctccagagacaacgccaagaactcactgtatctgcaaatnaaacagcctagagagccgaggacacggctgtgtattactgtgcgagtttgtttagggcgggatagcaggcgggtaccc

SEQ ID NO: 530994 - DNA, 505 bp, Homo sapiens
  misc_feature: HEFZJCU01B1NHG.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatcggggccacgaacgttactacgctagtggacgtcg

SEQ ID NO: 530995 - DNA, 509 bp, Homo sapiens
  misc_feature: HEFZJCU01EDQ08.48.81.H04.1.454.heavy.3.raw
agtatacatacacgaccggtgctcgatttagtagtgtagattcgcgggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagtttatctatctactactttagatt

SEQ ID NO: 530996 - DNA, 481 bp, Homo sapiens
  misc_feature: HEFZJCU01BWDNI.51.76.G10.1.454.heavy.3.raw
  modified_base (446)..(446): a, c, t, g, unknown or other
cgatcgtatacacgaccggtgctcgatttagtcactcatacaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaagggggctggagtgggtggcatttatatcagatgatggcagtaataaagagtatgcagtctccgtgaagggccgattcaccatctccagagacaattcccagaacacactagtatctgcaatgaacagattgagagntgaggacacggctgtgttatttctgtgcgaacgct

SEQ ID NO: 530997 - DNA, 556 bp, Homo sapiens
  misc_feature: HEFZJCU01EHYD8.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgagggacacggctgtgtattattgtgcgaagggcgagtggcgtggggacagtgggtacggtcgttgggggcccgaaaggggaacccacggggtcctaacccgttcc

SEQ ID NO: 530998 - DNA, 524 bp, Homo sapiens
  misc_feature: HEFZJCU01CUBZI.10.79.H02.1.454.heavy.3.raw
  modified_base (486)..(486): a, c, t, g, unknown or other
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgagggccgattcaccatctccagggacaacgccaagaactcactgactttgcaatgaacaccctgcgagccgaggcacggccgtatattacgtntgcgaagaataacccgttacgccttggttactttaccg

SEQ ID NO: 530999 - DNA, 506 bp, Homo sapiens
  misc_feature: HEFZJCU01D7VXB.48.77.G11.1.454.heavy.3.raw
agtatacatacacgaccggtgctcgatttagctagtcactcgaaggggaaaggggctctgggagacgacgcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagactaattccaaacaagacactgtatctgacaaatgaacagcctggagggctagaacgacacggctgtagtattactgtgcgagacggctatcactagtc

SEQ ID NO: 531000 - DNA, 401 bp, Homo sapiens; identical to SEQ ID NO: 449994
  misc_feature: HEFZJCU01EG961.47.24.C02.1.454.heavy.3.raw

SEQ ID NO: 531001 - DNA, 503 bp, Homo sapiens
  misc_feature: HEFZJCU01A7UED.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggaccacccccacgaacacagtctacatgcaactgacgagcctgagagctggacgacacggccgtctattactgtgcgagaatgttttctgtcatcgtacatttgataggctctatggactggacttcgtc

SEQ ID NO: 531002 - DNA, 502 bp, Homo sapiens
  misc_feature: HEFZJCU01AIQ8X.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcattgagtcgagtcaccatcgtcagtggactcgtccaagagtgagttctccctgaggctgacgtctttaagtgtcgctgatacggtgtctattctgtgcgagactgcccggtctgcacctcgtgtggcccattggttaccggcacacaaatcaggcagtcctacgacggtctc

SEQ ID NO: 531003 - DNA, 485 bp, Homo sapiens
  misc_feature: HEFZJCU01EXINA.17.36.D03.1.454.heavy.3.raw
  modified_base (479)..(479): a, c, t, g, unknown or other
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaaggtctggagtgggttgcatacattagtagtagtgatagttccatatactacgcagactctgtgaagggccgattcaccatctccagagacagtgccaagaactcactgtatctgcaaatgaacagccttagagacgacgacacggctgtgtattactgtgcgagngatccg

SEQ ID NO: 531004 - DNA, 518 bp, Homo sapiens
  misc_feature: HEFZJCU01BKGNU.4.57.F02.1.454.heavy.3.raw
agcactgtagcacgaccggtgctcgatttagctcgatatagttgggtttgggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacatttgaatctacagatgaacagtctgagagccgaggacacggctgtctattattgtgcgagagtaagtggtcatggtccttttgaccagtggggcagggaaccctggtcaccgtctcctcagcttccaccaacgggcccatcggtcttcccctgccgcctcgctccaggacgcacctctcgggggcacgacgcc

SEQ ID NO: 531005 - DNA, 430 bp, Homo sapiens
  misc_feature: HEFZJCU01EKYH0.4.37.D04.1.454.heavy.3.raw
  modified_base (418)..(418): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacngacctacatgga

SEQ ID NO: 531006 - DNA, 507 bp, Homo sapiens
  misc_feature: HEFZJCU01BA4EG.22.86.H09.1.454.heavy.3.raw
  modified_base (496)..(496): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgacatgactacgggaaagcttttgatctctggggccaagggacactggtcaccgtctcttcagcctccaccaagggcccatcggtctcccctggcgcccngctccaggacg

SEQ ID NO: 531007 - DNA, 497 bp, Homo sapiens
  misc_feature: HEFZJCU01EP9ED.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgcaggctccaggcgaggggctggagtgggtggcgattatatcacatgatggaactaagtagacgctatgccgactccgtgaagggccgattcaccatctccagagacaattccaagaacacgcagtatcctgacaaatgaacagcctgagagctagaggacacggctgtgtattactgtgggagagatgggaggtcgatattgta

SEQ ID NO: 531008 - DNA, 537 bp, Homo sapiens
  misc_feature: HEFZJCU01EMRZS.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgacccctggggggacccgggggaaccctgggtcacccggtctccccctaccctcc

SEQ ID NO: 531009 - DNA, 496 bp, Homo sapiens
  misc_feature: HEFZJCU01EVPZ6.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggttatttcgatctctggggccgtggcaccctggtcactgtctcctcggcttccaccaagggcccatcggtcttcccctggcgccctgctccaggagcacctctggggcacagcggccctgggctgcctgtcaaggactacttcctacgtcgtat

SEQ ID NO: 531010 - DNA, 501 bp, Homo sapiens
  misc_feature: HEFZJCU01DLA3J.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccaggggaagcctggtcaccgtctcctcagcctccaccaagggcccatcggtcttcccctggcgccctgctccaggagcgacctccgagagcacagcggccctgggctgcctggtcaaggactacttcctacgtcgta

SEQ ID NO: 531011 - DNA, 525 bp, Homo sapiens
  misc_feature: HEFZJCU01DE5HT.16.27.C05.1.454.heavy.3.raw
  modified_base (517)..(517): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcataatgatggaactactcaacactatccagactccggggagggccgattcaccgtctccagagacaattccaagaacagggtgtttctccaagtgattgatctgagaagtgaggacacggctgtttattactgtgcgcggtgctgaccgctcttgactactggggccgggagccccggtnactcgtct

SEQ ID NO: 531012 - DNA, 516 bp, Homo sapiens
  misc_feature: HEFZJCU01BSH24.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgtagtctggggctgaggtgaagaagcctggggcctcagtgaaggtctcctgcaaggcttctggattcacgtttacctcctatagtatcaactgggtgcgccaggtcgctggacaacgacctgagtggatgggatgggcgaacccgtaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagcctacgggcaggcggcctttgactttcgtggggaccg

SEQ ID NO: 531013 - DNA, 515 bp, Homo sapiens
  misc_feature: HEFZJCU01AVKRV.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccgaa

SEQ ID NO: 531014 - DNA, 511 bp, Homo sapiens
  misc_feature: HEFZJCU01DN48Q.13.76.G10.1.454.heavy.3.raw
  modified_base (443)..(443): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggatgcgtctcttttatttatagtagtggtagtacatactccgcagactccgtgaggggccgattcaccatctccagagacaattccaagaacacgctgttcttcaaatgaacagcctgagagccgatgaacncggccgtgtattactgtgcgagagatggagcccacgaacgtactacgctatggacgtctggggacaac

SEQ ID NO: 531015 - DNA, 522 bp, Homo sapiens
  misc_feature: HEFZJCU01DOL56.9.34.D01.1.454.heavy.3.raw
  modified_base (229)..(229): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgnttcatcatctccagagacaattcccagaacatactgtctctgcaactcaataacctgagaggcgaggacacggccatttatttatgtgcgaaggaggcatatgggaagtacgattttcgatccctcgcagtcgacactttgattactgggccgggaaccctggtcgccgtctcctcagcctccaccaagggcccatcgtcttcccctggcaccctcctccaagagcacctctgggggcacagccggccctgggctggcctggtcaaggactacttccagacgtatccactgac

SEQ ID NO: 531016 - DNA, 556 bp, Homo sapiens
  misc_feature: HEFZJCU01CFENK.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaacgggccgattccaccatctcagaagacaaattccaggaacacattgtatcttacaaatgaataacctgagagccgaggacacggcatgtattacgtgtggtgggggcattttacttcgaccccgttggggggcccgggggtaaaccctgggtccacccggtcctcccccaacccctcccaaaccc

SEQ ID NO: 531017 - DNA, 505 bp, Homo sapiens
  misc_feature: HEFZJCU01D08TM.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccgagggaaggggctggagtggctcgcacttatttacagtggcggcactacatactacacagacttcgcgagggccgattcaccatctccagagacgattccaagaacacgttgtatcttacaatgaacagcctgacagtcgacgactacggccatgtatttttgtgcgagcggaccggggcctccgtcaatggctttc

SEQ ID NO: 531018 - DNA, 363 bp, Homo sapiens
  misc_feature: HEFZJCU01D877L.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgtagacctgacgacacggtaccggtgtattattgtgcgttagttacggacgattacgacgttttgagttgggtcattacccggacgtgtggggcaaagggaccacggtcaccgtctcctcagccttccaccaagggcccatcggtcttccccctggcaccctcctccaagagcacctctggggcacgagcggccctgggctgcctggtcaaggactacttcctacgtgagct

SEQ ID NO: 531019 - DNA, 542 bp, Homo sapiens
  misc_feature: HEFZJCU01EF7W8.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctgggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagacgccgacgacaccgggcccatattaattaccttggtcgtcggaaaacgaccaccgggccaggttaacggtccaaccccatacctacttttgacttactgggggacccg

SEQ ID NO: 531020 - DNA, 504 bp, Homo sapiens
  misc_feature: HEFZJCU01BOGKL.53.54.E10.1.454.heavy.3.raw
  modified_base (479)..(479): a, c, t, g, unknown or other
cgcgtatacacacgaccggtgctcgatttagatcgtagcagaacacacaaaggggctgggagaggagcccagcactagaagtcggcggtgtttccattcggtgatcagcactgaacacagaggactcaccatggagtttgggttgagctgggttttcctcgttgctcttttaagaggtgtccagtgtcaggtgcacctggtggagtccgggggaggcgtggtccagcctgggaggtccctgagactctcctgtgtagcctctggattcacccttcagggtctatggcatgaactgggtccgccagactccaggcaaggggctggagtgggtggcatttatatcatttgatggcactaataaatactatgcagactccgtgaggtgccgattcaccatctccagagacaagttccaagaacatggtgtttctgcaatgaacagcctgagagttgaagacgacggctgtgtattactgtgngaaacggaatgagtggaacgtaggg

SEQ ID NO: 531021 - DNA, 513 bp, Homo sapiens
  misc_feature: HEFZJCU01BMMPX.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaactatgtggactctgtgaacggccgattcaccatctccagagacaacgccaagaattcactgtatttgcaaatgaacagcctgagaggcgaggacacggccgtgtattattgtgcgcgagatggatagtagactctacagtaagcaggtggta

SEQ ID NO: 531022 - DNA, 511 bp, Homo sapiens
  misc_feature: HEFZJCU01BOXZF.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaacgggcccatcggtcttcccctcggcgccccctgctccaggagcacctccgacgacgcacagccggcccgtcgggagtgccgtcggtcgaacggactaccg

SEQ ID NO: 531023 - DNA, 526 bp, Homo sapiens
  misc_feature: HEFZJCU01CFN85.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagctgtacgcccgccttggtctcgtcagttggtcaatccgccctccagggggacctttggggtttcgacccctggggccagggaaccctggtcaccgtctcctcagcctccaccaagggcccatcggtcttccccctggcaccctcctccaagacgcacctcg

SEQ ID NO: 531024 - DNA, 531 bp, Homo sapiens
  misc_feature: HEFZJCU01C4CJK.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagtttgaggagcctgacatctgacgacacggccgtcttatttactgtgcgagtagtcccacgacttccgggtgagcctacgggcaggccggcccttttgtactttcgtcggggggtcccgaggggtacc

SEQ ID NO: 531025 - DNA, 521 bp, Homo sapiens
  misc_feature: HEFZJCU01A3AA6.16.86.H09.1.454.heavy.3.raw
  modified_base (501)..(501): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtacttactgtgcgagagacccctcgatagcagtggctggtccacgtaggtttgacttactgggggccaggggaancgttggtcaccgtctccctc

SEQ ID NO: 531026 - DNA, 482 bp, Homo sapiens
  misc_feature: HEFZJCU01CK2RN.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacaacgggtgtatattactgtggaagtaggcccccataga

SEQ ID NO: 531027 - DNA, 508 bp, Homo sapiens
  misc_feature: HEFZJCU01C9PEM.48.71.G05.1.454.heavy.3.raw
agtatacatacacgaccggtgctcgatttagtgtcgtcgcaagagagaggggggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggaccttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgcttatggagggggaagactgggttcgactcctggggccagggaaccctggtcatcgtctcgtcagcctccaccaaggcccatcc

SEQ ID NO: 531028 - DNA, 531 bp, Homo sapiens
  misc_feature: HEFZJCU01EQKR2.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggctttattactgtcgcgaggagggacggacgtacggtgactactgggggttcgaccccgtgggccagggaaccctggtccaccgtctcctcacgcctccaaccg

SEQ ID NO: 531029 - DNA, 498 bp, Homo sapiens
  misc_feature: HEFZJCU01DIZSY.48.74.G08.1.454.heavy.3.raw
agtatacatacacgaccggtgctcgatttagtagctctatcaggggaggtctgggagaggagccccagccctgagattcccaggtgtttccattcagtgatcagcactgaacacagaggactcaccatggagttgggactgagctggattttccttttggctcttttaacaggtgtccagtgtgaagtgcagctggtggagtctgggggaggcttggtacagcccggcaggtccctgagactctcctgtgcagcctctggattcatctttggtgattatgccatgcactgggtccggcgaattccagggaagggcctggagtgggtctcaggtattagttgggatggtgacagtataggctatgcggactctgtgaggggccgattcaccatcaccagggaaaacgccgaataactccctgtgtctacaaatgaacaatctgagacctgaagacacggccttgtattttgtgtaaagatattctccgacattatggtc

SEQ ID NO: 531030 - DNA, 522 bp, Homo sapiens
  misc_feature: HEFZJCU01A5RIY.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaaggggacccg

SEQ ID NO: 531031 - DNA, 513 bp, Homo sapiens
  misc_feature: HEFZJCU01D84VK.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccggggggtccctgagactctcctgtgcagtctctggattcacccttagaagttattggatgacctgggtccgccaggctccagggaaggggctgggagtgggtggccaacataaacaaagacggaagtcagaaaaactatgtggactctgtgaacggccgattcaccatctccagagacaacgccaagaattcactgtatttgcaaatgaacagcctgagaggcggaggacgacggccgtgtattattgtgcgcgagatagatagagtatctacagtagcaggtgta

SEQ ID NO: 531032 - DNA, 488 bp, Homo sapiens
  misc_feature: HEFZJCU01AYT6X.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgactttacta

SEQ ID NO: 531033 - DNA, 524 bp, Homo sapiens
  misc_feature: HEFZJCU01EF3WF.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctgggggccaagggaccacggtcatcgtctcctcagcctccaccaacgggcccatcggtcctttccccctcggcctaccccg

SEQ ID NO: 531034 - DNA, 504 bp, Homo sapiens
  misc_feature: HEFZJCU01CN6S9.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattcccaggcaacacgctgtatctgctaaaatgaacagcctgagagctgaggacacggctgtgtattactgtgcgaaagattttcatagaggtgacgtacgggggcgtttcg

SEQ ID NO: 531035 - DNA, 503 bp, Homo sapiens
  misc_feature: HEFZJCU01EJOJ8.49.27.C05.1.454.heavy.3.raw
agtcgagagacacgaccggtgctcgatttagacgcgatcgaagggtttgggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatttatagcggtggtgacacatactacgcagactccgtgaagggcagattcaccatctccagagacggtttcaagaacacactctatcttcaaatgaacagcctgagagccgaggacacggctgtgtattactgtgcgagagacgtcccccgggtatagcagtgtctggta

SEQ ID NO: 531036 - DNA, 504 bp, Homo sapiens
  misc_feature: HEFZJCU01AOI63.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaaagcaagtggtccttacaatgaccaacatggaccctttggaccacacgccacatattactgtgcacaccacagggtctctactgctggctttcagtacaactggttacgaacccgtggggccagggaaccctggtcagcgtctcctcacgcct

SEQ ID NO: 531037 - DNA, 518 bp, Homo sapiens
  misc_feature: HEFZJCU01ECLVW.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgaagtgcctgagatctgaggacacggctgtttattactgtgcgagagggaagtggggatattgtggtcagctccaaggtcgcccacggcccggggtcccctactttcgactacgtc

SEQ ID NO: 531038 - DNA, 501 bp, Homo sapiens
  misc_feature: HEFZJCU01BOID2.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgacaaatgaacagcctgagagctgaggacacggctggtgttattactggtgggagagatgggaggtcgaatagttgtta

SEQ ID NO: 531039 - DNA, 540 bp, Homo sapiens
  misc_feature: HEFZJCU01DMFME.52.9.A09.1.454.heavy.3.raw
  modified_base (399)..(399): a, c, t, g, unknown or other
cgcagtacgacacgaccggtgctcgatttagcgagacgcgcaggggggctttccgagagtcatggacctcctgcacaagaacatgaaacacctgtggttcttcctcctcctggtggcagctcccagatgggtccttgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccnccgcggacacggctgtctattactgtgcgaaaggccctcacgatgaaaactacgcccctggcgctatggacgtctggggccaagggaccacggtcaccgtctcctcagcctccaccaagggcccatcggtccttcccctgg

SEQ ID NO: 531040 - DNA, 529 bp, Homo sapiens
  misc_feature: HEFZJCU01BJ4WI.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggaccttccaccctggttcctacttcgatctctgggggccgtc

SEQ ID NO: 531041 - DNA, 533 bp, Homo sapiens
  misc_feature: HEFZJCU01EB5IV.16.27.C05.1.454.heavy.3.raw
  modified_base (477)..(477): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctggggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagtaagtgaggacacggctgtttattactgtagcgnggtggctgaccgctcttgactacgtggggccggggaggccccggtcatcgtctccc

SEQ ID NO: 531042 - DNA, 521 bp, Homo sapiens
  misc_feature: HEFZJCU01E1RJC.49.81.H04.1.454.heavy.3.raw
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcaggttatatcgaatgatggaagtaagaagtactatgcagactccgtgaagggccgattcaccatctccagagacaattccaagaacacgctatatttgcacatgaacagcctgagagctgaggacacggctactttattaacttgtgacgaacgtttaatactacggaggacaaggggtacgacccccgt

SEQ ID NO: 531043 - DNA, 530 bp, Homo sapiens
  misc_feature: HEFZJCU01AC67A.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatcctccagagacaattccaagaacacgctgtatctgcaattgaacagcctgagagccggaggacacgggcccgtaagttactttaccttgttggccggtaaaaggtacgttttaggggggaaatttcggaacccgtaacgttacc

SEQ ID NO: 531044 - DNA, 493 bp, Homo sapiens
  misc_feature: HEFZJCU01EOF6L.51.1.A01.1.454.heavy.3.raw
  modified_base (437)..(437): a, c, t, g, unknown or other
cgatcgtatacacgaccggtgctcgatttagacgtctcatcagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacattccgagaacacgctgtatctgacaaatgaacagcctgagngttgaggacacggctgtgtattattgtgcgaacttatcacggaggacaacggtccg

SEQ ID NO: 531045 - DNA, 504 bp, Homo sapiens
  misc_feature: HEFZJCU01AD3SD.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggccacacgctgtatctgcaaatgaacagcctgagagctgaggacacggctgtgtagttactgttgacgaaagatttctatagaggtgacgtacggggggcgttcg

SEQ ID NO: 531046 - DNA, 501 bp, Homo sapiens
  misc_feature: HEFZJCU01C2MNK.19.86.H09.1.454.heavy.3.raw
tactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccaatgtattattgtgcgaggcaggacggggctaaaggcataaagtggttcgaccctggggccagggaaccctggtcaccgtctcctcagcctccaccaacgggccactcggtcttccccctggcgccctgctccaggagcacctccgagagcacagcggccctgggctgcctgtcaaggactacttcccacgagagta

SEQ ID NO: 531047 - DNA, 523 bp, Homo sapiens
  misc_feature: HEFZJCU01BQ0C6.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcacctgtctctggtggctccatcagcagcagtacttacttctggggctggatccgccagcccccagggaaggggcctggagtgggattgggagtagtttaccacagtgggagcgacctactacaacccgtcccctacaaacgtacgaggcaccatagtccgtagaccacgtccaagaaccaattctccctgaagctgagctctgtgaccgccgcagacacggctgtctatactgtgcgaggccccgagcgcgagtggtctttttgtgttgtccgtttgtagtacgtgttcggggggacccgaacggggaacc

SEQ ID NO: 531048 - DNA, 502 bp, Homo sapiens
  misc_feature: HEFZJCU01DKBUK.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggggtccctgagactctcctgcgcagcctctggattcaccttcagtagttatagcatgaactgggtccgccaggctccagggaagggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgttattactgtggcgagagggagctatttatctggaaccccg

SEQ ID NO: 531049 - DNA, 492 bp, Homo sapiens
  misc_feature: HEFZJCU01A27ZC.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctggggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaacctccctgtatctgcaaatgaacagtctgagagctgaggacacggccttgtattactgtgcaaggaggtat

SEQ ID NO: 531050 - DNA, 479 bp, Homo sapiens
  misc_feature: HEFZJCU01C48DQ.4.37.D04.1.454.heavy.3.raw
  modified_base (447)..(447): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaagtatgcacagaagtttcagggcagggtcaccatgaccaggggacacgtccatcagcacgtccatcagcacagcctacatgggacctgagcggcctgacanctgcgacacggccgtatatttctgtgcgaggg

SEQ ID NO: 531051 - DNA, 514 bp, Homo sapiens
  misc_feature: HEFZJCU01CG838.40.81.H04.1.454.heavy.3.raw
tctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctacagaggtggcacaaagtatcgacagaactttcgagggcaggggtcaccatgacctgggacgcgtccatcagcacagtctacatggatctgagtacgggactgaacctcgtacggacgacgacggacacgtgtattactggtaggtaagacggacgtggtggctacggcgggcgtacg

SEQ ID NO: 531052 - DNA, 551 bp, Homo sapiens
  misc_feature: HEFZJCU01DKOHX.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacactttttttgacttattggggccagggaatccgtggtcctaccgtcggtccctcacggccctcccaccgaacgggccccaagtccggtccttcccccg

SEQ ID NO: 531053 - DNA, 512 bp, Homo sapiens
  misc_feature: HEFZJCU01A1NSX.4.33.C11.1.454.heavy.3.raw
  modified_base (346)..(346): a, c, t, g, unknown or other
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagngccatggcttatgctgggacaacagaatacgccgcgtctgtgaaaggcagatctatcatctcaagagatgattccaacggcatcgcctatctgcagatgaacagcctagaagaccgaggacacagccgtctatttactgtgttagggtagttttacgtattttggt

SEQ ID NO: 531054 - DNA, 487 bp, Homo sapiens
  misc_feature: HEFZJCU01E0ZWJ.49.27.C05.1.454.heavy.3.raw
agtcgagagacacgaccggtgctcgatttagacgcgatcgaagggtttgggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaactttaac

SEQ ID NO: 531055 - DNA, 509 bp, Homo sapiens
  misc_feature: HEFZJCU01D9MSA.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggggccagggaaccctggtcaccgtctcctcagcctccaccaagggcccatcggtcttcccctgcgccctgctccaggagcacctccgagagcacagcggccctgggctgcctggtcaaggactacttccagacgtatca

SEQ ID NO: 531056 - DNA, 513 bp, Homo sapiens
  misc_feature: HEFZJCU01D4PBB.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctggggaggtccctgagactctcctgtgcaggctctggattcaccttcagtaactacggcgtgcactgggtccgccaggctccaggcaagggcttggagtggctggcagttgttcatctgaaggagtgttcaatactatacagactccgtgaagggccgattcaccatctccagagacaattccaagaacacgatgtatctgcaaatggacagcctaagagttaggaggacacggctgtttattactgtacgaaaggaggggggagtacgagtggcagctccaagtacttac

SEQ ID NO: 531057 - DNA, 531 bp, Homo sapiens
  misc_feature: HEFZJCU01BZY8U.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtatttactgtgcgagccacaccgattaccgatttttggagtgggccttgataaactggggtccaggggatccgtggtcaccgtctcctcagcctccaccaac

SEQ ID NO: 531058 - DNA, 523 bp, Homo sapiens
  misc_feature: HEFZJCU01EL0CH.4.28.C06.1.454.heavy.3.raw
  modified_base (457)..(457): a, c, t, g, unknown or other
agcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtggaggggccgattcaccatcttcagagacaacgccaaggacacgctgtatctggaaatgagcagtctgagagccgaggacacgggctggtntattactgtgacaagagataacgggacttggtacgcccttttgactactgggggccccggggaccc

SEQ ID NO: 531059 - DNA, 482 bp, Homo sapiens
  misc_feature: HEFZJCU01E03T4.10.35.D02.1.454.heavy.3.raw
  modified_base (418)..(418): a, c, t, g, unknown or other
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctgcgccctgctccngagcacctccgagagcacagcggccctcgggctgcctggtcaaggactacttcccactactatg

SEQ ID NO: 531060 - DNA, 523 bp, Homo sapiens
  misc_feature: HEFZJCU01APVUM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaaccctactggccaatactatgggggcttgttctggggccaggggaccctggtcatcgtctccccagcctccaccaaggcccatcggtccttcccctggccg

SEQ ID NO: 531061 - DNA, 519 bp, Homo sapiens
  misc_feature: HEFZJCU01DUU5U.9.34.D01.1.454.heavy.3.raw
  modified_base (511)..(511): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgatttttcgatccctccgcagtcgacactttgattactggggccggggaacccgtggtcgccgtctcctcagcctccaccaagggcccatcggtcttcccctggcaccctcctccaagagcacctctgggggcacagcggcccgtggctgcctggtcaaggactactccanacgtatca

SEQ ID NO: 531062 - DNA, 505 bp, Homo sapiens
  misc_feature: HEFZJCU01DQA8O.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggtcctttgacttcgt

SEQ ID NO: 531063 - DNA, 511 bp, Homo sapiens
  misc_feature: HEFZJCU01A59JW.47.23.C01.1.454.heavy.3.raw
agctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatgggatcagcattggcaatggtaacataaaacactcacagaagttccagggcagggtcaccattaccagagacatctccgcgaccacagcctacatggaactgagcagcctgacttctgaagacacggctatttactacttgtgcgagagaggggtttgacttggaactccttctacatgggacgtctgggggcaaaggggacc

SEQ ID NO: 531064 - DNA, 506 bp, Homo sapiens
  misc_feature: HEFZJCU01EKLJ9.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggagggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattacg

SEQ ID NO: 531065 - DNA, 523 bp, Homo sapiens
  misc_feature: HEFZJCU01DDD25.53.10.A10.1.454.heavy.3.raw
cgcgtatacacacgaccggtgctcgatttagcgtcgatctcagggtcttcgtggctcacgtccaccaccacgcatgtgacctcagggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcatccgccctccaggggggacctttggggttcgaccctggggccagggaccctggtcaccgtctcctcagcctccaccaagggccccatcggtcttccccctggccaccctccctccaagacgccacctcgtgggggg

SEQ ID NO: 531066 - DNA, 511 bp, Homo sapiens
  misc_feature: HEFZJCU01EYO4U.51.40.D07.1.454.heavy.3.raw
cgatcgtatacacgaccggtgctcgatttagtgatagagcgtaacaacagagggggctctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaaccacaactgtttctgcacatagaaaagcctgagagctgaggacacggctgtttattactgtgcggaacttaatacacggaggactaaaccc

SEQ ID NO: 531067 - DNA, 515 bp, Homo sapiens
  misc_feature: HEFZJCU01DFE2G.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaaccatgaccacgaacctcctccataaacacagcctacatgggagttgagggagcctgaccatctgacgacacggcccgtctattactgtgcgagagtcccagactccggtgagccctacggcaggcggtcctttggactttcgtc

SEQ ID NO: 531068 - DNA, 516 bp, Homo sapiens
  misc_feature: HEFZJCU01DQQQE.12.25.C03.1.454.heavy.3.raw
  modified_base (472)..(472): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattaactgtgcgagagtacgtagcggntcgtcctttgactatggggcctgggaactctggtcaccgtctcc

SEQ ID NO: 531069 - DNA, 531 bp, Homo sapiens
  misc_feature: HEFZJCU01BIWFV.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaactgaggtccgtcattgtcgcggacacagccgtcctattattgtgtcagagatccggcccataactggctcggccctggggcccggaaccctggtcaccgtctcctcagcctccaccagggcccatcggtccttccccctggccaccctcctccc

SEQ ID NO: 531070 - DNA, 517 bp, Homo sapiens; identical to SEQ ID NO: 480397
  misc_feature: HEFZJCU01A3OQI.3.17.B06.1.454.heavy.3.raw

SEQ ID NO: 531071 - DNA, 526 bp, Homo sapiens
  misc_feature: HEFZJCU01BYZVE.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttggatccagcctggggggtccctgagactctcctgtgcagcctctgggttcaccgtcagtcacacctacatgagctgggtccgccaggctccagggaaggggctgggagtgcgtctcttttatttatagtagtggtagtacatactccgcagactccgtgaggggccgattcaccatctcccagagacaattccaagaacacgctgtttcttcaaatgaacagcctgagagccgatgacacggcccgtgtattactgtgcgagagatggggcccacggaacgttactacggctatggacgtctgggggccaagggaccg

SEQ ID NO: 531072 - DNA, 506 bp, Homo sapiens
  misc_feature: HEFZJCU01CLNIC.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgaccgtgggacgcgtccatcagcacagtctacatggatctgagcggactgacctctgacgacacggccatgtattactgtggaagagacgttaggtggcttaccggcggggctggaccacgtcggggcc

SEQ ID NO: 531073 - DNA, 511 bp, Homo sapiens; identical to SEQ ID NO: 481036
  misc_feature: HEFZJCU01EVDQV.15.67.G01.1.454.heavy.3.raw

SEQ ID NO: 531074 - DNA, 511 bp, Homo sapiens
  misc_feature: HEFZJCU01BL6D7.51.36.D03.1.454.heavy.3.raw
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggacacgtccaaggaccagttctcctgaagctgacctctgtgaccgccgcagacacggctttgtatttctgtgctagatataatgtgggtgacagtggtgcctacgtacggagcttttgattagtttcggggcgaaggcacgaaggtcaccgtctcattcacg

SEQ ID NO: 531075 - DNA, 486 bp, Homo sapiens
  misc_feature: HEFZJCU01EV7XS.51.37.D04.1.454.heavy.3.raw
  modified_base (410)..(410): a, c, t, g, unknown or other
cgatcgtatacacgaccggtgctcgatttagtagcatactgttgggtttggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccganaacacgctgtatctgcaaatgaacaggctgagagctggaagacacggctgtatattactgtgcgtaacttaatcac

SEQ ID NO: 531076 - DNA, 494 bp, Homo sapiens
  misc_feature: HEFZJCU01EF4NL.13.86.H09.1.454.heavy.3.raw
  modified_base (483)..(483): a, c, t, g, unknown or other
tcacgtactacacgaccggtgctcgatttagtgctatagacttgggtttggggacccaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaaggagcctgagatatgacgacacggccgtgtattattgtgcgagagtggagtggcagtggatatcganaaatactacta

SEQ ID NO: 531077 - DNA, 506 bp, Homo sapiens
  misc_feature: HEFZJCU01E0JTK.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggtggccatataaaaagtaagactgctggtgagacaacagactacgctgctgccttcagaggcagattcaccatcttcagagatgaatcacagagcactctgtttctgcaaatgaacagcctggaagacggcggacacacgccatgtatttattgtacagttaggacactatacgg

SEQ ID NO: 531078 - DNA, 537 bp, Homo sapiens
  misc_feature: HEFZJCU01EAASU.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgttttattttgtacgtagagcgtcgtctgtcagtggaattgactacgtggggccagggtaaccctggtacaccgtctcctcagcctccaccgaaggg

SEQ ID NO: 531079 - DNA, 536 bp, Homo sapiens
  misc_feature: HEFZJCU01D9YL0.7.78.H01.1.454.heavy.3.raw
  modified_base (529)..(529): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctaacttcttggtggcagtagcaacaggtgcccactcccaggtgcagctggtacagtctgggtctgaattgaggaagcctggggcgtcagtgagcgttgcctgcaagcctcctggatacatcttcactacttattctgtcaattgggtccgacaggcccctggacaaggccttgactacatgggatggatcaacaccgacactgggaaccccacctatgcccaggccttcacagggcggtttgtcttctcccatggatacctctgtcgggacggcttatctgcagataaccaaccttcaacctgacgacactgccgtttatttttgttacggagagcgtcgtctgtcaggtggaattgaactctgggccagggaaccctggtcacgtctcctcagcctccnccaaggg

SEQ ID NO: 531080 - DNA, 526 bp, Homo sapiens
  misc_feature: HEFZJCU01BLESA.49.6.A06.1.454.heavy.3.raw
agtcgagagacacgaccggtgctcgatttagatctactgacagggggagagaggagcccagccctgggattttcaggtgttttcatttggtgatcaggactgagcagagagaactcaccatggagtttgggctgagcgtggctttttcttgtggctattttaaaaggtgtccagtgtgaggtgcagctggtggactctgggggaggcttggtacagcctggggggtccctgagactctcctgtgcagcctctggattcacctttagcagttttgccatgggctggggtccgccaggctccagggaaggggctggagtgggtctcaactattagcggtattggtactaccacatactacgcagactccgtgaagggccttcaccatctccagagacaattccaagaacatggtgtttctgcaaatgagcagcctgagagccgaggacacggccgtatattactgtgcgaaagttcgcgtgctaggtacatttgactactggggccgaggggaaacctggtctacccg

SEQ ID NO: 531081 - DNA, 497 bp, Homo sapiens
  misc_feature: HEFZJCU01C8KFX.48.23.C01.1.454.heavy.3.raw
agtatacatacacgaccggtgctcgatttagtacacgtgattagggattggggacccaacaaccacatccctcctcagaaggccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacgacggcagtatattactgtgcgagaggcggatattgtcgtgaggtgactgctacagtacaaatcgt

SEQ ID NO: 531082 - DNA, 535 bp, Homo sapiens
  misc_feature: HEFZJCU01CLEB0.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtacactactactactacggtatggactctggggaccg

SEQ ID NO: 531083 - DNA, 515 bp, Homo sapiens
  misc_feature: HEFZJCU01BEOI1.52.33.C11.1.454.heavy.3.raw
cgcagtacgacacgaccggtgctcgatttagagtgagctcgttgggtttgggacccaacaaccacatccctcctcagaagcccccagagcacaacgcctcaccatggactggacctggaggatcctctttttggtggcagcagccacaggtggccactcccaggtccagcttgtgcagtctgggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccaggggcagagtcaccatcaccagggacacatccgcgagcacagcctacatggagttgagcagcctgagaaatgaagacacggctgtatattactgtgcgagaggggaaagtgggtaaggagttttggagtaagttatttatcctggtcggtgcggacgtcgtc

SEQ ID NO: 531084 - DNA, 492 bp, Homo sapiens
  misc_feature: HEFZJCU01EP44Y.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccggtctcctcagcctccaccaagggcccatcggtcttccccctggcgccctgctccaggagcacctccgagagcacagcggccctgggctgcctggtcaggactacttccgtatctctcg

SEQ ID NO: 531085 - DNA, 522 bp, Homo sapiens
  misc_feature: HEFZJCU01DHRWJ.7.71.G05.1.454.heavy.3.raw
  modified_base (387)..(387): a, c, t, g, unknown or other
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggtttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccngagacaattccaggaacacaatgtatttggaaatgaacagcctaagtcctgagacacgggtgtatactactcgtagaaggaggggggaaccgagcggggagttaccaagtactcctttagacgtctggggcctac

SEQ ID NO: 531086 - DNA, 516 bp, Homo sapiens
  misc_feature: HEFZJCU01CIM2W.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccaactgggtgcggcaggcccctggacaagggcttgagtggatgggacacatcagccctaacactggtgacacaaactatgcacgagacgatttcagggcagggtcaccatgaccacggacacgtccataagcacagttacatggaggtaaactaggctgagagtctagacgacacggccgtagtattactgtgcgtttagttaacggtacgattacggacttgttttgatttggtttttacg

SEQ ID NO: 531087 - DNA, 527 bp, Homo sapiens
  misc_feature: HEFZJCU01BEKKN.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtggggtctcagttatttacaattctggtaccacatactactccgaccccgtgaagggccgattaaccatctcccagagacgattccgagaacacggtgtatcttcaaatgaacaacctgagagccgacgacacggccgtttatactgtgcgagagattcgagtgggttcggggacctcaccctggttctacttcgatctctggggccgtc

SEQ ID NO: 531088 - DNA, 507 bp, Homo sapiens
  misc_feature: HEFZJCU01AQZGC.2.49.E05.1.454.heavy.3.raw
acgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctattttaaaaggtgtccagtgcgaggtgctgctggtggagtccgggggaggcttagttcagcctggggggtccctgagactctcctgtgcagcctctggattcaccttcagtcgctactggatgcactggttccgccaagttccagggaaggggctggagtgggtctcacgcattgatccatctgggaataggattaactacgcggcctccgtgaggggccgattcaccatctccagagacaacgccaggaacactactgtatctggaaatgagcagtctcagaggcgaggacacggctgtttattactgcacagtgacgcgttcggggagactgactacgtggggccaggg

SEQ ID NO: 531089 - DNA, 518 bp, Homo sapiens
  misc_feature: HEFZJCU01CMFK1.48.41.D08.1.454.heavy.3.raw
agtatacatacacgaccggtgctcgatttagtcacgcgagaaagggaaaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactgaggacactgccgtgtattcttgtgtgagacgaagtagtagctcgcccttctttgactactggggccagggaaccctggtcaccgcctcc

SEQ ID NO: 531090 - DNA, 533 bp, Homo sapiens
  misc_feature: HEFZJCU01AZH5E.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccaggggcagactcaccataaaccgcggacaaattaacgaacacagttaatctggagctgaacagcctgtcatctgaggacacgggcttctacttctgtgcgaggagtaattactataacactgctcctttttacacctcccttcgacttctggggtccatcggaacccggtccg

SEQ ID NO: 531091 - DNA, 508 bp, Homo sapiens
  misc_feature: HEFZJCU01DYWSK.17.25.C03.1.454.heavy.3.raw
  modified_base (487)..(487): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccggggacagacttaccatgaccacgaactcctccaataacacagcctacatggagttgaggagcctgacatctgacgacacggccgtctattactgtgcgagacgtcccacgatccggtgagcctacggnaggcggcctttgactttccgt

SEQ ID NO: 531092 - DNA, 472 bp, Homo sapiens; identical to SEQ ID NO: 445355
  misc_feature: HEFZJCU01D9Q8L.4.37.D04.1.454.heavy.3.raw

SEQ ID NO: 531093 - DNA, 509 bp, Homo sapiens
  misc_feature: HEFZJCU01BLQFG.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccaggggaaggggctggagtgggtctcagttattgaaacagatggcactacattattattctgactccgtgaagggccggttcaccctctccagagacacttccaacaacatcttgtatcttcacatgcacaatctgagagtcgacgacaccggccacctattattgtgcgcgacatgactacgctcaattctggggccagggaccg

SEQ ID NO: 531094 - DNA, 515 bp, Homo sapiens
  misc_feature: HEFZJCU01B4SSQ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatgtcggggagttattagtcctactttgactactggggtccagggaactctggtcaccgtctccgcagcctccaccaagggcccatcc

SEQ ID NO: 531095 - DNA, 525 bp, Homo sapiens
  misc_feature: HEFZJCU01BKKYY.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgacctacgtgggggccaggggacgcccctgggtaccaccggtcctccctcacg

SEQ ID NO: 531096 - DNA, 514 bp, Homo sapiens
  misc_feature: HEFZJCU01A38KZ.18.39.D06.1.454.heavy.3.raw
tacgagtatgcacgaccggtgctcgatttagtgacatctcgtagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaaccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggccgccctgctccaggagcacctctggggcacagcggccctgggctgcctggtcaaggactacttccactactccg

SEQ ID NO: 531097 - DNA, 513 bp, Homo sapiens; identical to SEQ ID NO: 447518
  misc_feature: HEFZJCU01B1HV7.19.67.G01.1.454.heavy.3.raw

SEQ ID NO: 531098 - DNA, 487 bp, Homo sapiens
  misc_feature: HEFZJCU01A5G4X.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaatgaacagcctgagagtcgaggacacggtccgtatattattgtgcccttgattacta

SEQ ID NO: 531099 - DNA, 542 bp, Homo sapiens
  misc_feature: HEFZJCU01BLSOY.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccacgttaggtttgacttacgtcgggggccaggggaatcgtttgggtaccaccggttctcctacacgcctacccg

SEQ ID NO: 531100 - DNA, 507 bp, Homo sapiens
  misc_feature: HEFZJCU01BZYLX.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatgggatggatcaacgtacagactggtggcacagactatgcacagggactccgagggcagactcaccatgaccacagacacatcagcgaacacagtcaacatggagttgcggagcctgcgatctgacgacgccggccgtatattactgtgcgagagtacgtagcgctccgtctttgactactgggctggactctggtcacgt

SEQ ID NO: 531101 - DNA, 545 bp, Homo sapiens
  misc_feature: HEFZJCU01EDGE5.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggcctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtcgtggggccgaagggacgctggtcaccgtctcttcagcctccaccaagggcccatcggtcttccccgtcggccaccctcctccaagagcacctctgggggcacgagcc

SEQ ID NO: 531102 - DNA, 533 bp, Homo sapiens
  misc_feature: HEFZJCU01EIWPQ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagccctccaccaaggg

SEQ ID NO: 531103 - DNA, 512 bp, Homo sapiens
  misc_feature: HEFZJCU01AOZME.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtctgggg

SEQ ID NO: 531104 - DNA, 510 bp, Homo sapiens
  misc_feature: HEFZJCU01AU0MI.4.81.H04.1.454.heavy.3.raw
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgatttcaccatctccagagacaacgccaagaactcagtgtttctgcaaatgaacaagcctgagagtcgaggactcggctgtctactactgtgcgaggaataagggagctaccctacgattttcggacac

SEQ ID NO: 531105 - DNA, 510 bp, Homo sapiens
  misc_feature: HEFZJCU01B44J3.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccatctccagagacaattccaagaacacgctgtttcttcaaatgaacagcctgagagccgatgacacggccgtgtattactgtgcgagagagtggggcccacgaacgttacctaacgcttagtggacggtcgt

SEQ ID NO: 531106 - DNA, 512 bp, Homo sapiens
  misc_feature: HEFZJCU01EWJTA.19.85.H08.1.454.heavy.3.raw
tactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccaggctcccaggaaaggggctggagtggattgcctatgtcactagtgagggcgaagtcacgtcctacgcggactctgtgcgggccggtttaccatctccagagacaatgccaagaagacgctctttctgcaattggacggcctgagagtcgaagacacggctattttattacttgtgtgagaggaggggggcgacgttggctgggtcggggtcgta

SEQ ID NO: 531107 - DNA, 395 bp, Homo sapiens; identical to SEQ ID NO: 446634
  misc_feature: HEFZJCU01BK991.10.42.D09.1.454.heavy.3.raw

SEQ ID NO: 531108 - DNA, 528 bp, Homo sapiens
  misc_feature: HEFZJCU01BH5I8.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggggagtttagttagtccctacttttgactactggggccgagggaactcttggtcaccgtctccgcagcctccacccaacggggccccagtcc

SEQ ID NO: 531109 - DNA, 497 bp, Homo sapiens; identical to SEQ ID NO: 469118
  misc_feature: HEFZJCU01A1IOK.48.23.C01.1.454.heavy.3.raw

SEQ ID NO: 531110 - DNA, 489 bp, Homo sapiens
  misc_feature: HEFZJCU01BR47S.53.73.G07.1.454.heavy.3.raw
cgcgtatacacacgaccggtgctcgatttagctctacgctcagggggcatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctggggcctcagtgatgatttcctgcacgacatctggatacaccttcaccgactcccttatacattgggtacgacaggccccctggacaggggcttgagtggatgggtctaatcaaccctagtggtggatctacaagttactcacagagaatgcagggccgaattaccatgaccagagacacgtccacgagtacagtctacatggaggtgagcagcctgagatctgaggacacggccatgtattactgtgcgatcttagtggattacgactacaatatttgtcacg

SEQ ID NO: 531111 - DNA, 492 bp, Homo sapiens; identical to SEQ ID NO: 444695
  misc_feature: HEFZJCU01EN7IS.3.34.D01.1.454.heavy.3.raw

SEQ ID NO: 531112 - DNA, 482 bp, Homo sapiens
  misc_feature: HEFZJCU01B8YDP.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcacatctccagagacaacgccaagaactccctgtatctgcaatgaacagtctgagagctgaggacacggcctttgtattacgtagtgcaagggagtatag

SEQ ID NO: 531113 - DNA, 514 bp, Homo sapiens
  misc_feature: HEFZJCU01C7FWK.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcaggactcaccatgaccacagacacatcaagcgaacacagtcaacatggagttgcggagcctgcgatctgacgacgcggccgtatattactgtgcgagagtacgtagcggctcgtcctttgactactggggcctgggactctggtcaccgtct

SEQ ID NO: 531114 - DNA, 519 bp, Homo sapiens
  misc_feature: HEFZJCU01CVGV6.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctgggggggggcttagtcaagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacgggctatctattactgtgcgaaacctctcattccgtttcatctgaatactgggggccacggggaaccctggtcgtcccg

SEQ ID NO: 531115 - DNA, 405 bp, Homo sapiens
  misc_feature: HEFZJCU01DNWTB.12.27.C05.1.454.heavy.3.raw
atacgacgtacacgaccggtgctcgatttagacgcgatcgaagggtttgggtgcccaagctgctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcatttgggggagtcatcgtccttgagtactggggcaaagggaccacggtcaccgtctcctcagcctccaccaagggcccatcggtcttccccctggcaccctcctccaagagcacctctggggcacagcggccctgggctgcctggtcaaggactacttcctacgtcgtat

SEQ ID NO: 531116 - DNA, 498 bp, Homo sapiens
  misc_feature: HEFZJCU01EG0JA.49.7.A07.1.454.heavy.3.raw
  modified_base (453)..(453): a, c, t, g, unknown or other
agtcgagagacacgaccggtgctcgatttagcacgtgtcgcaggggctgggagtcgagcccagcactgggagtcgccggtgtttccattcggtgatcatcactgaacacagaggactcaccatggagtttgggctgaactgggttttcctcgttgctcttttaagaggtgtccagtgtcaggtgcagttggtggagtctgggggaggcgtggtccagcctgggaggtccctgagactctcctgtgcagcctctggattcaccttcaatagttatggtttgcactgggtccgccaggctccaggcaagggtctggagtgggtggcttttatatcctatgatggtagcgataagtactacgcagattccgcgaagggtcgattcaccatctccagagacaagtccaagaagacgctgtatctggacatgaccagcctgagatctgaggacacggntgtctacttctgtgcgagaggcaccgagcagcgagtccaccctac

SEQ ID NO: 531117 - DNA, 513 bp, Homo sapiens
  misc_feature: HEFZJCU01ASRPJ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttacccatcgaccacgaactcctccataaacacagcctacatggagttgaggagcctgacatctgacgacacggccgtctattactgtgcgagacgtcccacgactccggtgagccgtacggcagccggtacctttgtacttcgtc

SEQ ID NO: 531118 - DNA, 519 bp, Homo sapiens
  misc_feature: HEFZJCU01BKHNE.13.76.G10.1.454.heavy.3.raw
tcacgtactacacgaccggtgctcgatttagtcactcatacaggggcgtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagacacgctgtttcttcaatgaacagcctgagagccgatggacacggccgtgtatactgtgcgagagagtggggcccacgaaccgttactaccgctagtggtacgtcgtggggaccg

SEQ ID NO: 531119 - DNA, 324 bp, Homo sapiens; identical to SEQ ID NO: 451709
  misc_feature: HEFZJCU01APFBF.4.19.B08.1.454.heavy.3.raw

SEQ ID NO: 531120 - DNA, 515 bp, Homo sapiens
  misc_feature: HEFZJCU01BZ6UB.49.59.F04.1.454.heavy.3.raw
agtcgagagacacgaccggtgctcgatttagtacacacacttagggattgggggcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctgggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaacccg

SEQ ID NO: 531121 - DNA, 536 bp, Homo sapiens
  misc_feature: HEFZJCU01AKYOH.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattggtagttagtaccagcttgcttagtttttcgtcccgggttggtttccggacccccgttgggggcccagggggaacccctgggtccaccgtctcctc

SEQ ID NO: 531122 - DNA, 506 bp, Homo sapiens
  misc_feature: HEFZJCU01CPR9S.47.23.C01.1.454.heavy.3.raw
agctcacgtacacgaccggtgctcgatttagtacacgtgattagggattggggcccaacaatcacatccctcctcagaagccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaacactcacagaagttccagggcagggtcaccattaccagagacatctccgcgaccacagcctacatggaactgagcagcctgacttctgaagacacggctatttacactgtgcgagagaggggtttgacgtggaactccttctacatggacgtctgggggcaaaggggaccg

SEQ ID NO: 531123 - DNA, 503 bp, Homo sapiens
  misc_feature: HEFZJCU01BVVA2.51.83.H06.1.454.heavy.3.raw
cgatcgtatacacgaccggtgctcgatttagatcacgtgcgtcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcagatctgaggacacgctatctactactgtagtgaaagtaattgggtttcagtggcttactttcg

SEQ ID NO: 531124 - DNA, 396 bp, Homo sapiens; identical to SEQ ID NO: 444469
  misc_feature: HEFZJCU01B3EFD.47.46.E02.1.454.heavy.3.raw

SEQ ID NO: 531125 - DNA, 497 bp, Homo sapiens
  misc_feature: HEFZJCU01E1GGD.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtta

SEQ ID NO: 531126 - DNA, 506 bp, Homo sapiens
  misc_feature: HEFZJCU01BBTS9.17.10.A10.1.454.heavy.3.raw
  modified_base (313)..(313): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagnggctttgacggtaaggcacagtatgcaccgaagatgaagggcagagtcacgattaccacggacacccccacgaacacagtctacatgcaactgacgagcctgagagcgtgacgacacggccgtctattactgtgcgagaatgttttctgtcatcgtacaatttgattaggctctatggtactggtacttcgtc

SEQ ID NO: 531127 - DNA, 308 bp, Homo sapiens
  misc_feature: HEFZJCU01A8Q8V.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcatggggaggtgtgtcacaagatttgggctctgggcaccgtgggcatgggggaggtgtgtcacaagatttgagccctggtcaccgtctcctcagcttccaccaagggcccatcggtcttccccctggcgccctgctccaggagcacctctggggcacagcggccctgggctgcctggtcaaggactacttcctctctcgact

SEQ ID NO: 531128 - DNA, 531 bp, Homo sapiens
  misc_feature: HEFZJCU01EK3PL.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacggcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccacgcctccaccaacgggcccatcggtcttccccctggccgcctcg

SEQ ID NO: 531129 - DNA, 513 bp, Homo sapiens
  misc_feature: HEFZJCU01AO5O9.48.81.H04.1.454.heavy.3.raw
agtatacatacacgaccggtgctcgatttagtagtgtagattcgcgggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagaccgtgaggacacggccatttactactgtgcggcggggaggtggacgggagcgttccggttttcggagttatcatctactacttt

SEQ ID NO: 531130 - DNA, 508 bp, Homo sapiens
  misc_feature: HEFZJCU01AJX9F.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatcctccagagaacaatggacaacactcactgtatctaggaatacaacacgctgagagtcgaggacgacggctgtatattagttgtgcgagacgtcccccgtacggtcgtacc

SEQ ID NO: 531131 - DNA, 487 bp, Homo sapiens
  misc_feature: HEFZJCU01AZXVD.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaagggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattagtgtgcccttgatttacta

SEQ ID NO: 531132 - DNA, 316 bp, Homo sapiens
  misc_feature: HEFZJCU01CG7BZ.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgaggct

SEQ ID NO: 531133 - DNA, 523 bp, Homo sapiens
  misc_feature: HEFZJCU01EHCWL.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgagacacggctgtctattactgtgcgagagactacggtgaccttttctggtatttcgatctctggggccgtggcaccctggtcactgtctcctcggcttccaccacggcccatcggtcttcccctcggccgccctcgctccacggagcgacctcgtcgggggtcgacgaggccggccc

SEQ ID NO: 531134 - DNA, 534 bp, Homo sapiens
  misc_feature: HEFZJCU01AKHXT.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagccctcccaccaagggcccgactcggtcttccccctggccgccctcg

SEQ ID NO: 531135 - DNA, 531 bp, Homo sapiens
  misc_feature: HEFZJCU01E0EWN.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtgggtggtaccacatactacacagactccgtgaagggccgattcaccatctcagaagacaattccaggaacacattgtatcttcaaatgaataacctgagagccgaggacacggccatgtattactgtgtggggcagtttacttgacccctggggccggggaaccctggtcaccgtctccccaccctccaccg

SEQ ID NO: 531136 - DNA, 506 bp, Homo sapiens
  misc_feature: HEFZJCU01BGBA2.13.9.A09.1.454.heavy.3.raw
tcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggaccacagccatctattactgtgctagagagtattgcagtcctagacctgccta

SEQ ID NO: 531137 - DNA, 517 bp, Homo sapiens
  misc_feature: HEFZJCU01CT0JP.51.81.H04.1.454.heavy.3.raw
cgatcgtatacacgaccggtgctcgatttagtagtgtagattcgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctgacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggaccgagtaaggttcgcttactggttcggaggcgtctccccctacgg

SEQ ID NO: 531138 - DNA, 542 bp, Homo sapiens
  misc_feature: HEFZJCU01CCY0Z.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgccactggatttcccttcaatttctattccatgcacttggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagaacagcctgagaccagacgacacggctgtctattattgcgcgagagagacacacgaacctactggccaatactagtgggggcttgttcttgggggccacggggaccctgggtcatcggtctccccacgcctccaccaacgggacccatcggtcttcccccttcggccgtccctcg

SEQ ID NO: 531139 - DNA, 522 bp, Homo sapiens
  misc_feature: HEFZJCU01BHF44.22.41.D08.1.454.heavy.3.raw
acatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggatctgaggtgaagaagcctggggcctcagtgaaggtctcctgcaaggcttctggttacacgtttaggagctatggtatcgtttgggtgcgacaggcccctggacaacggcctgagtggatgggatggatgaacccttctaagggaaacacaaactatgcagagaggctccagggcagagtcaccatgaccgcagacacaccaacgaccacagcctacatggagttgaggagtctgagacctgacgacacggccgtatattactgcgcgaggaggcggggggtttctacggtcgactactgagtatctctaggcacgtggggccgagggccaccgt

SEQ ID NO: 531140 - DNA, 523 bp, Homo sapiens
  misc_feature: HEFZJCU01ETI41.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgaccctccgatagcagtggctggtccactaggtttgactactggggccagggaagcgtggtcaccgtctcctcacgcctcc

SEQ ID NO: 531141 - DNA, 551 bp, Homo sapiens
  misc_feature: HEFZJCU01CZJVS.4.35.D02.1.454.heavy.3.raw
agcactgtagcacgaccggtgctcgatttagcacacgatagttggggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatgggttcgggagatcccagttggtttttggtattatagtgggggtccgacgggggacaaggccgggttccaacccggtccttctttccacggt

SEQ ID NO: 531142 - DNA, 509 bp, Homo sapiens
  misc_feature: HEFZJCU01D51EA.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaatgaggacacggccttttatttctgtgcaaaggtggaaccacatatttcacaagctaggcactggta

SEQ ID NO: 531143 - DNA, 527 bp, Homo sapiens
  misc_feature: HEFZJCU01CMBY5.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagttggccttgataactggggccaggggatccgtggtcaccgtctcctcagcctccaccaac

SEQ ID NO: 531144 - DNA, 549 bp, Homo sapiens
  misc_feature: HEFZJCU01CH943.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatcttgcagataaccaaccttcaacctgacgacactgtcgtttatttttgtacgagagcgtcgtctgtcagtggaattgactactggggccgacgggaacccgtggtccaccggttctccctcgacgcctcccaccaacgggccccg

SEQ ID NO: 531145 - DNA, 542 bp, Homo sapiens
  misc_feature: HEFZJCU01DI6WC.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaaagcacgctgtatctgcaaatgaacagcctgacgaaccgaggacacagccgtgtattactgtaccacactccctagaaagcgtacaactactactactacggtatcggacctccgtggggacc

SEQ ID NO: 531146 - DNA, 550 bp, Homo sapiens
  misc_feature: HEFZJCU01DBBBY.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagcctttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgcgcggacacggccgtgtattactgtgcgagaggattgttggttttactcgttggttcaatgagttattatgtctttgacttattggggccaggggaaccctggtccaccgtctcctcacgcctccaccaacggg

SEQ ID NO: 531147 - DNA, 503 bp, Homo sapiens
  misc_feature: HEFZJCU01CTG5K.17.10.A10.1.454.heavy.3.raw
  modified_base (451)..(451): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacggattaccacggacacccccacgaacacagtctacatgcaactgacgagcctgagagctgacgacacggccgtctattactgtgcganaatgttttctgtcatcgtactaatttgataggctctatggactggacttctc

SEQ ID NO: 531148 - DNA, 433 bp, Homo sapiens
  misc_feature: HEFZJCU01BAW6I.16.71.G05.1.454.heavy.3.raw
tgtactactccacgaccggtgctcgatttagtgtcgtcgcaagagagagggagcccagccctgggatttcaggtgttttcatttggtgatcaggactgaacagagagaactcaccatggagtctgggctgagctggcttttcttgtggctattttaaaaggtgtccagtgtgaggtgcagctgttggagtctgggggaggcttggcgacagcctgggggggtccctgagactctctgtgcagtcctctcggattcacctttgactagctatgccatgacctgggtccgccaggctccagggaggggctggaagtgggtctcgaggtattactgggtggtaggttataaccactatactacgacagacttcccgtggaaaggggtccggttcgtaccatccttccgaagagacgtaacttcaaacgaacacaac

SEQ ID NO: 531149 - DNA, 514 bp, Homo sapiens
  misc_feature: HEFZJCU01EJAC5.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgcaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgttgttttcgatgccttcggtccgcgggacttcgtggggccgagggtaacccg

SEQ ID NO: 531150 - DNA, 527 bp, Homo sapiens
  misc_feature: HEFZJCU01D7X2D.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgacgcgcaatctatctggaactgagccgcctgacatctgcagactcgggcaggtatatttctgttgcgagagagggggagagtggttgaggggaattgttattccgatacctatttggaccacgtacggggccaggggtaaccccg

SEQ ID NO: 531151 - DNA, 530 bp, Homo sapiens
  misc_feature: HEFZJCU01DK4FP.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcacctttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacggcttctacttctgtgcgaggagtaagttactataacactgctcctttttacaccttcctcgacttctgggccatcggaaccccgtccg

SEQ ID NO: 531152 - DNA, 517 bp, Homo sapiens
  misc_feature: HEFZJCU01DIWU4.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagtatttgacgacgacggccatatattactgtgcgagagagttgggccgacggaaaccttgactacgtggggccgagggaacccgtggtcaccgt

SEQ ID NO: 531153 - DNA, 531 bp, Homo sapiens; identical to SEQ ID NO: 458117
  misc_feature: HEFZJCU01BWGQP.7.78.H01.1.454.heavy.3.raw

SEQ ID NO: 531154 - DNA, 500 bp, Homo sapiens
  misc_feature: HEFZJCU01CF67Q.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtggtggggtgggtcagcggctttgacggtaaggcacagtatgcaccgaagatgaagggcagagtcacgattaccacggacacccccacgaacacagtctacaatgcaactgacgagcctgagagctgacgacacggccgtctattactgtgcgagaatgttttcngtcatcgtacaatttgataggctctatggatggacttctc

SEQ ID NO: 531155 - DNA, 482 bp, Homo sapiens
  misc_feature: HEFZJCU01EF4VG.48.41.D08.1.454.heavy.3.raw
agtatacatacacgaccggtgctcgatttagtcacgcgagaaagggaaagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagccctacatggagctgagcagcctgagatctgaggacacgggccgtgtattactgtgcgagagatcagagtggttatt

SEQ ID NO: 531156 - DNA, 501 bp, Homo sapiens
  misc_feature: HEFZJCU01CIKZT.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacaccggaccgtatatttcttgcgcgagagacgtaaagtgacgtggtagttccggggggacgac

SEQ ID NO: 531157 - DNA, 493 bp, Homo sapiens
  misc_feature: HEFZJCU01CE31C.40.81.H04.1.454.heavy.3.raw
tctagcgactcacgaccggtgctcgatttagtagtgtagattcgcgggggtgtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcagcccctggacagggtttggagtggatggggtgggatcaaccctaccagaggtggcacaaagtatcgacagaactttcagggcagggtcagcatgacctgggacggcgtccatcagcacagtctacatggatctgagcggacgtggacctctcgacgacacggccatgtattactgtggaagagacgtggtgctaccgc

SEQ ID NO: 531158 - DNA, 526 bp, Homo sapiens
  misc_feature: HEFZJCU01A20OK.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggaccgtttattactgtgcgagagattcgagtggttcggggacctcaccctggttctacttcgatctcgtggggccgt

SEQ ID NO: 531159 - DNA, 508 bp, Homo sapiens
  misc_feature: HEFZJCU01BJLOL.49.52.E08.1.454.heavy.3.raw
agtcgagagacacgaccggtgctcgatttagtcgagctctctcggcgggcacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatgggatcaccgctggcaatggtgacacaaaatattcagagaagttccagggcagagtctccattaccagggacacagctgcgagtacagggtacagtggaactgaggtggcctgagatctgaggacacgggctgtttattactgtgcgaggagggaagtggggatatt

SEQ ID NO: 531160 - DNA, 511 bp, Homo sapiens
  misc_feature: HEFZJCU01A0G2I.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaacccgtaacactggtgtcacagtgtcttcacccatcctccgggacagacttaccatgaccacgaactcctccataacacagcctacatggagttgaggagcctgacatctgacgacacggccgtctattactgtgcgagacgtcccacgatccggtgagcctacggcagcggcctttgacttctggggcccagggacg

SEQ ID NO: 531161 - DNA, 514 bp, Homo sapiens
  misc_feature: HEFZJCU01C7G6V.49.86.H09.1.454.heavy.3.raw
agtcgagagacacgaccggtgctcgatttagtgctatagacttgggtttggggacccaacaaccacatccctcctcagaagcccccagagcacaacgcctcaccatggactggacctggaggatcctctttttggtggcagcagccacaggtgcccactcccaggtccaacttgtgcagtctggggctgagttgaagaagcctggggcctcagtgaaggtttcctgcacggtttctggataccccctcagcagtcatgctatgcattgggtgcgccaggcccccggacaaaggtttgagtggatgggatggatcaccgctggcaatggtgacacaaaatattcacaaaagttccagggcagagtcaccatttacagggtacacatctgcgagttcaggctacatggaactgagcgggcctggagagtactgaggacgacggctatttattactgttgcgagagggaatggggatattgtgtcagctccaggtgccagccggcccctactttgaa

SEQ ID NO: 531162 - DNA, 528 bp, Homo sapiens
  misc_feature: HEFZJCU01BG95K.51.27.C05.1.454.heavy.3.raw
cgatcgtatacacgaccggtgctcgatttagacgcgatcgaagggtttggggggggagacgagcccagcactggaagtcgccggtgtttccatttcggtgatcatcactgaacacagacatggagttttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcaccgtggtacgggggagtttacttcctccgcaacggtatggacgttcg

SEQ ID NO: 531163 - DNA, 520 bp, Homo sapiens
  misc_feature: HEFZJCU01DQDQ2.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcaggtggctggtccacgttaggtttgactacgtggggccaggggaagcttggtcaccgtctcctc

SEQ ID NO: 531164 - DNA, 488 bp, Homo sapiens; identical to SEQ ID NO: 447044
  misc_feature: HEFZJCU01BPTKB.18.70.G04.1.454.heavy.3.raw

SEQ ID NO: 531165 - DNA, 379 bp, Homo sapiens
  misc_feature: HEFZJCU01AV54L.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattggtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 531166 - DNA, 507 bp, Homo sapiens
  misc_feature: HEFZJCU01DSEIP.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgaacacggccacctattattgtgcgcgacatgactacgctcaattctggggccaggggacg

SEQ ID NO: 531167 - DNA, 533 bp, Homo sapiens
  misc_feature: HEFZJCU01DJ6K3.48.81.H04.1.454.heavy.3.raw
agtatacatacacgaccggtgctcgatttagtagtgtagattcgcggggaggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgagagaatcctggggaccggccgtcttccggggcagggaacactggtatcgtctcttc

SEQ ID NO: 531168 - DNA, 491 bp, Homo sapiens; identical to SEQ ID NO: 446104
  misc_feature: HEFZJCU01C2O2E.3.34.D01.1.454.heavy.3.raw

SEQ ID NO: 531169 - DNA, 525 bp, Homo sapiens
  misc_feature: HEFZJCU01D7VVO.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggtctacttcgatctctggggccgtc

SEQ ID NO: 531170 - DNA, 519 bp, Homo sapiens
  misc_feature: HEFZJCU01AJAQW.12.55.E11.1.454.heavy.3.raw
  modified_base (482)..(482): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcacctttacccagttatgctatgcactgggtccgccaggctccagggaaggggctggaatgggtggcagttatatcatatgatggaagctatcaatattacgcagattctgtgaagggccgactcaccatctccagagacaattccagaaacaaacgtgtatcttcaaataaacagtctgagacttgaggacacggctgtctattacctgtgcgagagactacggtgaccttttctggtatttcgatctctggggccgtggcaccctggtcactgtctcctcggcttccaccaagggcccatcggtcttcccctgcgcctnctccaggagcacctcgtcgggggcacgagcggtcccg

SEQ ID NO: 531171 - DNA, 541 bp, Homo sapiens
  misc_feature: HEFZJCU01A4O5R.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgcttcctttttacaccttccctttcgtacctttcgtggggccatcggaaccccggttaccg

SEQ ID NO: 531172 - DNA, 486 bp, Homo sapiens
  misc_feature: HEFZJCU01DM8AU.40.83.H06.1.454.heavy.3.raw
tctagcgactcacgaccggtgctcgatttagatcacgtgcgtcgcggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagcctgacagtcgaggacacggctgtatatttctgtgacgtaatgagggtaa

SEQ ID NO: 531173 - DNA, 496 bp, Homo sapiens
  misc_feature: HEFZJCU01DIOB1.4.19.B08.1.454.heavy.3.raw
  modified_base (434)..(434): a, c, t, g, unknown or other
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggagcgtggtccagcctgggagtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgngaggtgacgacacgggtgtttattactgtgcgtcgggatagaggctcatcgtggatacaact

SEQ ID NO: 531174 - DNA, 505 bp, Homo sapiens
  misc_feature: HEFZJCU01A69E0.11.71.G05.1.454.heavy.3.raw
  modified_base (144)..(144): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttccncgttttttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtggaagggccgattcaccgtctccagagacaattccaggcacacgctgtatctgcaaatgaacagcctgagagctgaggacgacggctgtgtattactgtgcgaaagatttctatagaggtgacgtacgggggcgttcg

SEQ ID NO: 531175 - DNA, 509 bp, Homo sapiens
  misc_feature: HEFZJCU01B4JL7.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctccctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggacttcgtgggccgagggaacct

SEQ ID NO: 531176 - DNA, 511 bp, Homo sapiens
  misc_feature: HEFZJCU01ASX4V.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggtccctgagactctcctgtgcagcctctggattcaccttcagtagctatagcatgaactgggtccgccaggctccagggaagggctggagtgggtctcatccattagtagtagtagtagttacatatactacgcagactcagtgaagggccgattccaccattcctccagagacaacgcccaagaactcactgtatctgcaaatgaacagcctgagagccgaggacacggctgtgtattactgtgcgtagtttgtttggggacggtataggcaggccgggtaccc

SEQ ID NO: 531177 - DNA, 505 bp, Homo sapiens
  misc_feature: HEFZJCU01DZMEY.48.25.C03.1.454.heavy.3.raw
agtatacatacacgaccggtgctcgatttagtagtgtagatttgggtttggggagctctcagagaggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctgggggagccttggtgcagcctggagagtccctaagactctcctgcgcagcctcaggattcagtttcagtagttatgaaatgaattgggtccgccaggctccagggaagggactggagtggctttcatatattactggcagtggggtctcttacccattatgcagactctgtgaggggccgattcaccatctccagagacaacccccgaaactctctttttctgcaaatggacagcctgacagccgacgatacggccatttattactgtgcgagagatcgggaccccgcatactcc

SEQ ID NO: 531178 - DNA, 535 bp, Homo sapiens
  misc_feature: HEFZJCU01D7UZW.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccaccaaggccc

SEQ ID NO: 531179 - DNA, 512 bp, Homo sapiens
  misc_feature: HEFZJCU01EJEZJ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcggtggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatgggagttgaggagcctgacatctgacgacacggccgtctattactgtgcgagacgtcccacgatccgggtgagtcctacggcaggccggcctttgacttcgtc

SEQ ID NO: 531180 - DNA, 498 bp, Homo sapiens
  misc_feature: HEFZJCU01DCRVA.52.85.H08.1.454.heavy.3.raw
cgcagtacgacacgaccggtgctcgatttagtatcactcagtcgcggggtatcactcagtcgcggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgaacagtccaagaaccacttctccctgaagctgacctctgtgactgccacagacacgggccgtctatttactgtgccagagggatcgctagaggtggctccattcgttttagacttcc

SEQ ID NO: 531181 - DNA, 501 bp, Homo sapiens
  misc_feature: HEFZJCU01AMNGY.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattacgtgtgcgaaagtatttctatagaggtgacgtac

SEQ ID NO: 531182 - DNA, 537 bp, Homo sapiens
  misc_feature: HEFZJCU01EZLH8.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgttgaggtccagttggttgagtccggggggaggcctggtccagcctgggggggtccctgagactctcctgtgcagcctccgggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatcttacaactgaacagcctgagagtcgcagacacggccgtgtattactgtgcgagatgtgaaaaagtaataggctgtgtttattggggccagggagccctggtcaccgt

SEQ ID NO: 531183 - DNA, 521 bp, Homo sapiens
  misc_feature: HEFZJCU01BT5YZ.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaaacaacctgagagccgacgacacggccgtttattactgtgcgagagattcgagtggttcggggacctcgaccctggttctacttcgatctctc

SEQ ID NO: 531184 - DNA, 513 bp, Homo sapiens
  misc_feature: HEFZJCU01BXQWW.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttaacaatgaccaatatggaccctgtggacacagccacatattactgttcacgctctatggttcggggagttattagtccctactttgactactgggccagggaactctggtcaccgtctccgcagcctccaccaagggccc

SEQ ID NO: 531185 - DNA, 511 bp, Homo sapiens
  misc_feature: HEFZJCU01D56WD.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggaccatgtatttttgtgtcgagcgacccggggctccctcaatggctttcattacg

SEQ ID NO: 531186 - DNA, 505 bp, Homo sapiens
  misc_feature: HEFZJCU01AY6JN.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctatttatgtgcgcgacatgactacgctcaattctgggccagggacg

SEQ ID NO: 531187 - DNA, 550 bp, Homo sapiens
  misc_feature: HEFZJCU01E1R1K.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagacacgctgtatctgcaaatagaacagcctgagaaccgaggacacagccgtgtattactgtaccacatcccctgaaagcgtctaactactacctaactacggtatggacctctggggccgaacgggtaccg

SEQ ID NO: 531188 - DNA, 537 bp, Homo sapiens
  misc_feature: HEFZJCU01BACE9.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgccttgcaagccttctggatacatcttcactacttattctgtcaattgggtccgacaggcccctggacaaggccttgactacatgggatggatcaacaccgacactgggaaccccacctatgcccaggccttcacagggccggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccacccaacggg

SEQ ID NO: 531189 - DNA, 316 bp, Homo sapiens; identical to SEQ ID NO: 472706
  misc_feature: HEFZJCU01COITS.47.84.H07.1.454.heavy.3.raw

SEQ ID NO: 531190 - DNA, 527 bp, Homo sapiens
  misc_feature: HEFZJCU01CTA98.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctctagaacacactgtctcttcaaatgaacagcctgaggggccgaggacacggccgtcgtattatttgtgttgaggtagtttatgggcatgggcctgggtggacaggatcactgggggcctaac

SEQ ID NO: 531191 - DNA, 493 bp, Homo sapiens
  misc_feature: HEFZJCU01BHN09.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctcgggggcacagcggccctgggctgcctggtcaaggactacttccgagtgcgtct

SEQ ID NO: 531192 - DNA, 459 bp, Homo sapiens
  misc_feature: HEFZJCU01ANK1C.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcacgtgg

SEQ ID NO: 531193 - DNA, 522 bp, Homo sapiens
  misc_feature: HEFZJCU01BNYCU.52.78.H01.1.454.heavy.3.raw
cgcagtacgacacgaccggtgctcgatttagtgtgagtagtttgggtttggggctcggagaggagccttagccctggactccaaggcctttccacttggtgatcagcactgagcacagaggactcaccatggagttggggctgagctgggttttccttgttgctattttagaaggtgtccagtgtgaggcgcagctggtgggagtctgggggaggcttggtccagcctggggggtccctgacactctcctgtgtagcctctggattcacctttaacagttattggatgacttgggtccgccaggctccagggaagggggctggagtgggtggccagcgtgaagcatgatggaggtgaggaagactatgcggactctgtgaagggccgattcaccacttccagagacaacatcaagaactcaatgtatctccaaatgagcagcctgacatcccgaggaccacggcccggtgtaatttactgtgcgaggagtttcgttttgggattggtttgttcgttgcaccc

SEQ ID NO: 531194 - DNA, 535 bp, Homo sapiens
  misc_feature: HEFZJCU01EL8QD.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtacccacatactacacagactccgtgaagggccgattcaccatctcagaagacaattccaggaacacattgtatcttcaaatgaataacctgagagccgaggacacggccatgtattactgtgtggggcatttacttgacccctggggccggggaacccgtggtccaccggtctccccacccctccaaccg

SEQ ID NO: 531195 - DNA, 528 bp, Homo sapiens
  misc_feature: HEFZJCU01C5DIK.49.28.C06.1.454.heavy.3.raw
agtcgagagacacgaccggtgctcgatttagagctcacgtattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccacggcccccggacaaggccttgagtggatgggatggatcaactctgacaatggtagcagacaacattcaccgaagttccaggacagagtcaccattacccgagacacttccgcgaaccacagcctacatggaactgagcggcctgagattgaagacacggctgtgtattactgtgcgacgagcaacggtcgtcagtgggatttgacttacgtgggggaccacggggaacccccggtcgacccggtcctcctc

SEQ ID NO: 531196 - DNA, 514 bp, Homo sapiens
  misc_feature: HEFZJCU01DGE28.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgcctttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccggggaacctggtcgccgtctcctcagcctcaccaagggcccatcggtcttcccctgcaccctcctccaagagcacctctgggggcacagcggccctgggctgcctggtcaaggctacttccagacgtatca

SEQ ID NO: 531197 - DNA, 521 bp, Homo sapiens
  misc_feature: HEFZJCU01CP2JZ.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccagggcccatcggtcttcccctggcgccctgctccaggagcacctccgagagacacacgcgcccc

SEQ ID NO: 531198 - DNA, 506 bp, Homo sapiens
  misc_feature: HEFZJCU01D8GXX.4.75.G09.1.454.heavy.3.raw
  modified_base (423)..(423): a, c, t, g, unknown or other
agcactgtagcacgaccggtgctcgatttagtatagacatcagggtcttcgtgacgtccctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcacccaaggaccgcctccaaaaaccacggtggtccttacaatcgaccaacatggaccctgtcggacacagccacatattactntgcacagagatacgggcagcacgtggtttggggctactggggccagggaaccctggtcgaccgtcgtcctcagcctccaaccg

SEQ ID NO: 531199 - DNA, 532 bp, Homo sapiens
  misc_feature: HEFZJCU01BZG76.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattcccaagaacagggtgtttctccaagtgattgatctgagaagtgaggacacgggctgtttattactgtgcgcggtggctgaccggctcttgactactgggggccgggggaggcccccggtcatccgtc

SEQ ID NO: 531200 - DNA, 509 bp, Homo sapiens
  misc_feature: HEFZJCU01ERABK.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttgggggcttttgaccactggggccagggaaccctggtcaccgtctcttcagcctccaccaagggcccatcggtcttccccctggccaccctcctccaagagcacctctgggggcacgagcggccctgggctgcctggtcaaggctacttccgtactagacg

SEQ ID NO: 531201 - DNA, 541 bp, Homo sapiens
  misc_feature: HEFZJCU01BS3F8.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctggggaggcttggtacagccgggggggtccctgagactctcctgtgcagcctctggattcaatttaacagcttgccatgggctgggtccgccaggctccagggaaggggctggagtgggtctcgaatattaatgaaaggggtgataacacatactatgcggactctgtaaggggccggttcaccatctccagagacaattccaagaaacactgtatctgcaattaaccagcctgagagtcgaggacacggccctttattactgtgcgaaggatcgcccctataatggtggttggatcggggagtttggttcctggggccagggaaccctggtctacccg

SEQ ID NO: 531202 - DNA, 547 bp, Homo sapiens
  misc_feature: HEFZJCU01DTC2U.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtactctgcaaatgaacagcctgagaaccgaggacacagccgtgtattactgtaccacatcccctagaaacgcgtacaactactactactacggtataggacctcgtgggccgaagggaccg

SEQ ID NO: 531203 - DNA, 482 bp, Homo sapiens
  misc_feature: HEFZJCU01BU0M0.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgtcgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccagagcacctctgggggcacagcggcctgggctgcctggtcaaggactacttccgtatctctcg

SEQ ID NO: 531204 - DNA, 516 bp, Homo sapiens
  misc_feature: HEFZJCU01DQZNP.13.23.C01.1.454.heavy.3.raw
tcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtacttctaccactacggaatggacgtctggggccaagggaccgcggtcaccgtctcctcagcctccaccaagggcccatcggtcttccccctggcaccctcctccaagagcacctctgggggcacagcggccctcgggctgcctggtcaaggactacttcctagtacgtga

SEQ ID NO: 531205 - DNA, 508 bp, Homo sapiens
  misc_feature: HEFZJCU01A9P50.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattatctgactccgtgaagggccggttcaccctctccagagacacttccaacaacatcttgtatcttcacatgcacaatctgagagtcgacgacacggccacctattattgtgcgcggacatgactacgctcaattctaggggccagggtacg

SEQ ID NO: 531206 - DNA, 491 bp, Homo sapiens
  misc_feature: HEFZJCU01ESWBV.49.84.H07.1.454.heavy.3.raw
  modified_base (471)..(471): a, c, t, g, unknown or other
  modified_base (485)..(485): a, c, t, g, unknown or other
agtcgagagacacgaccggtgctcgatttagcagacgtctgtcgcggggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgagggccgattcaccatctccagagacaacgccaagaactcactgtatctccaaatgaacagcctgagagtcgaggacacggctgtctattactgtgngagagactcccaanagcggc

SEQ ID NO: 531207 - DNA, 500 bp, Homo sapiens
  misc_feature: HEFZJCU01BH2RV.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactggtgggagaaatcctaagtggctac

SEQ ID NO: 531208 - DNA, 529 bp, Homo sapiens
  misc_feature: HEFZJCU01EDKGC.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggatacggtgactacgtgggggttcgaccccgtggggccaggggaaccctggtcaccgtctcctcagcctccaaccg

SEQ ID NO: 531209 - DNA, 541 bp, Homo sapiens
  misc_feature: HEFZJCU01EHIGG.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccgagggaaacctggtcaccgtccttccccagccttcctaccgaacggggccccaagtccggttcctttcccccg

SEQ ID NO: 531210 - DNA, 518 bp, Homo sapiens
  misc_feature: HEFZJCU01AJ8CD.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagctccaccaaggcccatcggtcttcccctggcgccctgctccaggagcacctcgtgggggcacacgccggtcccg

SEQ ID NO: 531211 - DNA, 524 bp, Homo sapiens
  misc_feature: HEFZJCU01CYA2F.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgtattcaccatctccagagacaactccaggaacacaatgtattggacctgaacagcctaaggtcctgaggacacgggtgtatactactgtacgaaggaggggggaaccaggcgggagttccaagtactctttgacgtctc

SEQ ID NO: 531212 - DNA, 467 bp, Homo sapiens
  misc_feature: HEFZJCU01DH2G6.8.71.G05.1.454.heavy.3.raw
ctcgcgtgtccacgaccggtgctcgatttagtgtcgtcgcaagagagagggggcagagcctgctgaattctggctgaccagggcagtcaccagagctccagacaatgtctgtctccttcctcatcttcctgcccgtgctgggcctcccatggggtgtcctgtcacaggtacgactgcagcagtcaggtccaggactggtgaagccctcgcagaccctctcactcacctgtgtcatctccggggacagtgtctctaggcacggtagtacttggaattggatcaggcagtccccatcgagagccttgagtggctgggaaggacattctacacgtccaaattgtataatgaatatgcagagtctgtgaagagtcgaataatcatcagcccagacacatcgaagaccagttctccctggaactgacctctgtgactcccgaagacgacggctgtttattattgtgcaagag

SEQ ID NO: 531213 - DNA, 503 bp, Homo sapiens
  misc_feature: HEFZJCU01EEYNS.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgacaaacgtatgtcttttgatatggtggggacc

SEQ ID NO: 531214 - DNA, 526 bp, Homo sapiens
  misc_feature: HEFZJCU01E0AYO.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccactcggtcttccccctggtccaccctcctccaagagcacctctggggggcacacgcggccctgggctgcctggtcaaggac

SEQ ID NO: 531215 - DNA, 521 bp, Homo sapiens
  misc_feature: HEFZJCU01E1IWW.49.9.A09.1.454.heavy.3.raw
agtcgagagacacgaccggtgctcgatttagcgagacgcgcagggggagcccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgtggtcgactgtcgacctggactggtacttcgattctggtggggccgtggc

SEQ ID NO: 531216 - DNA, 496 bp, Homo sapiens
  misc_feature: HEFZJCU01DT2D5.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctgggagtgggtggcgattatatcacatgatggaactaatagacgctatgccgactccgtgaagggccgattcaccatctccagagacaattccaagaacacgcagtatctgcaaatgaacagcctgagagctagaggacacggctgtgtattactgtgggagagatgggaggtcgatattgta

SEQ ID NO: 531217 - DNA, 504 bp, Homo sapiens
  misc_feature: HEFZJCU01EZDZ0.48.38.D05.1.454.heavy.3.raw
  modified_base (320)..(320): a, c, t, g, unknown or other
agtatacatacacgaccggtgctcgatttagtatctgatagttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaancgtcccttcttcaactagaacgcactacgcacagaagttcggaggacagagtcacatttatggtggataaagccacgagcacagtctacatgcagtctgagcagcctgagacacaacgacaccggccgtctattattgttccaggagaattaacgtcgtcgtagaaacgttaaaagaatagtac

SEQ ID NO: 531218 - DNA, 511 bp, Homo sapiens
  misc_feature: HEFZJCU01ELALS.48.34.D01.1.454.heavy.3.raw
agtatacatacacgaccggtgctcgatttagatcgtctgtgttgggtttggggtctgtgttgggtttgggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggagtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagggccgattcgccttctccagagacaattccaagagcacggttcatctgcaaatgagcgccctgagacctgacgacacggctgtctattactgtgcgagagggcgtccgagtttaacacgtcc

SEQ ID NO: 531219 - DNA, 510 bp, Homo sapiens
  misc_feature: HEFZJCU01B8N47.49.62.F07.1.454.heavy.3.raw
agtcgagagacacgaccggtgctcgatttagtagtcgcataaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtggggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttcccctggcaccctcctccaagagcacctctgggggcacagcggccctgggctgcctggtcaaggactacttcctctctcgact

SEQ ID NO: 531220 - DNA, 498 bp, Homo sapiens
  misc_feature: HEFZJCU01AMIMZ.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggtccatcggtcttccccctggccgccctgctccaggagcacctccgagagcacagcggccctggctgcctggtcaaggactac

SEQ ID NO: 531221 - DNA, 510 bp, Homo sapiens
  misc_feature: HEFZJCU01A38IX.52.39.D06.1.454.heavy.3.raw
cgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagtggtactttttactacagttggagtcgccagcccccagggaagggactagagtggattgggagtgttcatcataatgggaggaccttctacagcccgtccctacaagagccgagtcaccatatcaatggacacgtccaggaaccacctctccctgaacctcaactctgttacggccgcggacacggccgtgtattattgtgcgagggaggcccaaaatggtggcgactcgcctcacttgacctctggggccagggaaggctggtcatcgt

SEQ ID NO: 531222 - DNA, 499 bp, Homo sapiens
  misc_feature: HEFZJCU01B9CG8.11.41.D08.1.454.heavy.3.raw
cgagagataccacgaccggtgctcgatttagtcacgcgagaaagggaaagggtctccgaagccttcggagaccctgtccctcacctgcactgtctctggtgactccatcagtaggtactattggagctggatccggcagcccccagggaagggactggagtggattgggtggatgtattacagtgggagcaccaactacaacccctccctcaagagtcgagtcaccatatcagtagacatgtccaagaaccagtgctccctgaagctgagctctgtgaccgctgcggacacggccgtgtattactgcgcgaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggcctggctgcctggtcaaggactacttccgtatctctcg

SEQ ID NO: 531223 - DNA, 536 bp, Homo sapiens
  misc_feature: HEFZJCU01CXOC7.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccgtgggggacccggggaaccctcggtcaccgtcctccccacccctccaaccg

SEQ ID NO: 531224 - DNA, 529 bp, Homo sapiens
  misc_feature: HEFZJCU01A7JQ3.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcgttatctgcagataaccaacttcacctgacgacactgccgtttattttgtacgagagcgtcgtctgtcagtggaattgactactggggcagggaacctggtcaccgtctcctcagcctcaccaagggccc

SEQ ID NO: 531225 - DNA, 505 bp, Homo sapiens
  misc_feature: HEFZJCU01BQZJJ.51.59.F04.1.454.heavy.3.raw
cgatcgtatacacgaccggtgctcgatttagtacacacacttagggattggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaagggggctggagtgggtggcagttatatcctatgatggaagcaataagcactacgcagagtccgtgaagggccgattgaccatctccagagacaactcgaagaatacggttcttctacaaatgaacagcctgagagctgagacacggctatgttttactgtgcgagagggaactcgattacagcagccctacg

SEQ ID NO: 531226 - DNA, 490 bp, Homo sapiens
  misc_feature: HEFZJCU01BN61Q.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactggacgacacgtctctctactactgtgcgagagagttgacgagtcattgtgagcttgactcctggggccagggaaccctagtcatcgtctcctcagcctccaccaagggcccatcggtcttcccctggcgccctgctccgagagcacctccgagagcacagcggccctgggctgcctggtcaaggactacttcctacgtgagct

SEQ ID NO: 531227 - DNA, 518 bp, Homo sapiens
  misc_feature: HEFZJCU01EMUYS.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccgaggtggtccttacaatgaaccaatatggaccctgtggacacagccacatattactgttcacgctctatggttcgggggagttattagtccctactttgactactgggccagggactctggtcaccgtctccgcagcctccaccaacggcccatcc

SEQ ID NO: 531228 - DNA, 558 bp, Homo sapiens
  misc_feature: HEFZJCU01EELP3.12.40.D07.1.454.heavy.3.raw
  modified_base (385)..(385): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggccaaggggctcgagtgggtggcactttattgcacatgatggcgtcaacaaattctacgcaaattccgtgaggggccgattcaccatctccagagacaattacaagaacaccctttatctgcaaatagacagccctgagacccngaaccgacacggctgtctattatttgcgcgagagagacaacacgaacctactggccaatactatgggggcttgttctgggggtccagggggacccctcgggttcagtcgtccgtcccctacgccctcccaccaacggggcccaatccggtcgttcccccttggccgcccgtcg

SEQ ID NO: 531229 - DNA, 547 bp, Homo sapiens
  misc_feature: HEFZJCU01D7HDJ.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccagtccggtccttcccctcggccgccctgcctccagggacgcacctccgacgacggccacgaggccggccccgtcggggtccg

SEQ ID NO: 531230 - DNA, 526 bp, Homo sapiens
  misc_feature: HEFZJCU01C2QD8.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcccgtgggctcgcctggtcaaggactacttccagacgtatacactgac

SEQ ID NO: 531231 - DNA, 546 bp, Homo sapiens
  misc_feature: HEFZJCU01D730G.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtgatggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaaatgatggtgagaaaatagactacggtgcacccgtgaaaggaagattcaccatctcaagagataattcaaaaacgacggtgtatttgcaaatgaacagcctagaaaccgaggacacagccgtctattactgtaccacagattcggaagtgcatcgacgtaaaggaggctatgcttttgatatctgggggcccagggacct

SEQ ID NO: 531232 - DNA, 512 bp, Homo sapiens
  misc_feature: HEFZJCU01EHV29.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacacgacttaccatgaccacgaacctcctccataaacacagcctacatggagttgaggagcctgacatctgacgacacggccgtctattactgtgcgagagtcccacggactccggtgacgcctacggcaggccggtcctttgacttcgtc

SEQ ID NO: 531233 - DNA, 536 bp, Homo sapiens
  misc_feature: HEFZJCU01CDPXG.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccagtatattactgttgcgagaaggacggtttttgggggcggcgggacgtcctctttcgagatctggggccagggggacgaagtggtcaccgtctcgtttcaggt

SEQ ID NO: 531234 - DNA, 497 bp, Homo sapiens
  misc_feature: HEFZJCU01BNWW8.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtctagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacgacggccgtatattactgtgacgaaagtagttaggggaatgaccacgtc

SEQ ID NO: 531235 - DNA, 520 bp, Homo sapiens
  misc_feature: HEFZJCU01EWBR8.51.57.F02.1.454.heavy.3.raw
cgatcgtatacacgaccggtgctcgatttagctcgatatagttgggtttggggtctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacgagggctgtttatttactgtgtgcgatccgacctcactggtacggggaggttacttccgtccgcgaaccggt

SEQ ID NO: 531236 - DNA, 428 bp, Homo sapiens
  misc_feature: HEFZJCU01BJL6K.4.78.H01.1.454.heavy.3.raw
agcactgtagcacgaccggtgctcgatttagtgtgagtagtttgggtttgggcgatttagtgtgagtagtttgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccatcggtcttcccctggcgccctgctccaggagcacctccgagagcacagcggccctgggctgcctggtcaaggactacttcctacagtgct

SEQ ID NO: 531237 - DNA, 512 bp, Homo sapiens
  misc_feature: HEFZJCU01B2GZP.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaacccaggtggtccttacaatgaccaatatggaccctgtggacacagccacatattactgttcacgctctatggttcggggagtttattagtccctactttgactactggggccagggactctggtcaccgtctccgcagcctcaccaaggccc

SEQ ID NO: 531238 - DNA, 475 bp, Homo sapiens
  misc_feature: HEFZJCU01B2F0C.9.81.H04.1.454.heavy.3.raw
tgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactctcctgtgccgcctctggattcatgtttgatgattatgccatgcactgggtccggcaagttccagggaagggcctggagtgggtctcaggtattacttggagtagcactaccacaggctatgcggactctgtgaggggccgattcaccatctccagagacaacgccaagaactccctatatctgcaaatgaatggtctgagagttgaggacacggccttgtattactgtg

SEQ ID NO: 531239 - DNA, 518 bp, Homo sapiens
  misc_feature: HEFZJCU01CQ3JD.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctggggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtagtattactgtcgcgagacgaccgctacgtcgggggcccgggagcccctggtcc

SEQ ID NO: 531240 - DNA, 513 bp, Homo sapiens
  misc_feature: HEFZJCU01BYT7V.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattatgtgcgagagtaagtggtcatggtccttttgaccagtggggccagggaacccctggtccaccgtctcctcagcttccaccaagggcccatccggtcttcccctggcgccctgctccagagcacctctggggcacagcgccg

SEQ ID NO: 531241 - DNA, 526 bp, Homo sapiens
  misc_feature: HEFZJCU01B31KQ.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaaccccgtcctcaagagtcgagtcagcatgtcagtcgacaccgtcccagaaccagttcctccctgacagtgagttatatgaccgccgcagacacggccgtgtattactgtgcgagagaggccgttagttttaggaccagcttagttaaaaactcctactacggtctggacgtcgtggggccgaggggaccaac

SEQ ID NO: 531242 - DNA, 521 bp, Homo sapiens
  misc_feature: HEFZJCU01BEFO0.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgaccgacaccgggccgtctattattgtgtcatagacctaggatacaacgacggtggtacctggtattc

SEQ ID NO: 531243 - DNA, 492 bp, Homo sapiens; identical to SEQ ID NO: 445919
  misc_feature: HEFZJCU01DI7B3.14.25.C03.1.454.heavy.3.raw

SEQ ID NO: 531244 - DNA, 491 bp, Homo sapiens; identical to SEQ ID NO: 447981
  misc_feature: HEFZJCU01D8AG1.47.85.H08.1.454.heavy.3.raw

SEQ ID NO: 531245 - DNA, 491 bp, Homo sapiens; identical to SEQ ID NO: 447981
  misc_feature: HEFZJCU01EB9AX.47.85.H08.1.454.heavy.3.raw

SEQ ID NO: 531246 - DNA, 481 bp, Homo sapiens
  misc_feature: HEFZJCU01BXSXS.5.34.D01.1.454.heavy.3.raw
atcagacacgcacgaccggtgctcgatttagatcgtctgtgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagacctgagagctgaggacacgctgtgtattactgtgcgag

SEQ ID NO: 531247 - DNA, 504 bp, Homo sapiens
  misc_feature: HEFZJCU01EK3P4.53.76.G10.1.454.heavy.3.raw
cgcgtatacacacgaccggtgctcgatttagtcactcatacagggggagtctccctcactgcccagctgggatctcagggcttcattttctgtcctccaccatcatggggtcaaccgccatcctcgccctcctcctggctgttctccaaggagtctgtgccgaggtgcagctggtgcagtctggaacagaggtgaaaaagccgggggagtctctgaagatctcctgtaagggttctggatacaactttaccacctactggatcgcctgggtgcgccagatgcccggaaaaggcctggagtggatgggcatcgtcaatcctagtgactctgaagccacatacagcccgtccttccaaggccaggtcaccctctcagccgacaagtccatcagcgccgccttcctgcagtggcgcggcctggaggcctcggacaccgccacatattactgtgcgagacttacatttgggggagttatcgttgttcctccactgggtgtcttttgat

SEQ ID NO: 531248 - DNA, 513 bp, Homo sapiens
  misc_feature: HEFZJCU01EQ0EY.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgatccaacggcatcgcctatctgcagatgaacagcctgaagaccgaggacacagccgtactattactgtggttagggtagttttacgtagtttttggta

SEQ ID NO: 531249 - DNA, 490 bp, Homo sapiens
  misc_feature: HEFZJCU01EM6XL.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctgcgccctgctccaggagcacctccgagagcacagcggccctgggctgccgtggtcaaggactacttcccactactcgta

SEQ ID NO: 531250 - DNA, 524 bp, Homo sapiens
  misc_feature: HEFZJCU01EE2DO.49.14.B03.1.454.heavy.3.raw
agtcgagagacacgaccggtgctcgatttagtgtgagtagttccggcgggcacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggtacacatccacgagcactattttcatggaactgagcagcctcagatccgaggacacggccgtttactactgtgcgagcgatcccggattcccgcgtttccgaggatgactactggggccagggaaccctggtcaccgtctcctcagcctccacctaaggcccatcggtcttccccctggcaccctcctccaaga

SEQ ID NO: 531251 - DNA, 509 bp, Homo sapiens
  misc_feature: HEFZJCU01AOGNJ.51.81.H04.1.454.heavy.3.raw
cgatcgtatacacgaccggtgctcgatttagtagtgtagattcgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagagttcgcttactggttcgaggctcctcccctacg

SEQ ID NO: 531252 - DNA, 498 bp, Homo sapiens
  misc_feature: HEFZJCU01A4YGQ.12.55.E11.1.454.heavy.3.raw
  modified_base (479)..(479): a, c, t, g, unknown or other
atacgacgtacacgaccggtgctcgatttagcactcgcacgttgggttttcctcgttgctcttttaagaggtgtccagtgtcagatgcagctggtggagtctggggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacgggctgtctattactgtgcgagagactacggtgaccttttctggtatttcgattctctggggccgtggcacctggtcactgtctctcggcttccaccaaggcccatcggtcttcccctgcgcctnctccagagcacctctgggg

SEQ ID NO: 531253 - DNA, 488 bp, Homo sapiens
  misc_feature: HEFZJCU01EE5NB.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctgcgccctgctccagagcacctccgagagcacagcggccctgggctgcctggtcaaggactactcccacgagagta

SEQ ID NO: 531254 - DNA, 511 bp, Homo sapiens
  misc_feature: HEFZJCU01ECLGG.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagaggccgacgacacggctatctattactgtgcgaaactctcattccgttcatctgaatactggggccagggaaccctggtcgccg

SEQ ID NO: 531255 - DNA, 502 bp, Homo sapiens
  misc_feature: HEFZJCU01AROK0.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccagggcgaggggctggagtggggtggcgattatatcacatgatggaactaatagacgctatgccgactcgtgaaggggccgattcaccatcctccagagacaattccaagaacacgcagtatctgcaaatgaacagcctgagagctgaggacacggctgtgtaattactgtggggagaggagtggaggtacgatagttgta

SEQ ID NO: 531256 - DNA, 483 bp, Homo sapiens
  misc_feature: HEFZJCU01AZDF7.7.10.A10.1.454.heavy.3.raw
  modified_base (437)..(437): a, c, t, g, unknown or other
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccaggggaaccctcgtcaccgtctcctcagcctccaccaagggcccatcggtcttcccctggcaccctcctccaagagcacctctgggggcncagcggccctgggctgcctggtcaaggactacttcctagagacacg

SEQ ID NO: 531257 - DNA, 397 bp, Homo sapiens; identical to SEQ ID NO: 509184
  misc_feature: HEFZJCU01DJ2BL.47.46.E02.1.454.heavy.3.raw

SEQ ID NO: 531258 - DNA, 533 bp, Homo sapiens
  misc_feature: HEFZJCU01D60AM.52.35.D02.1.454.heavy.3.raw
cgcagtacgacacgaccggtgctcgatttagcacacgatagttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccggtctccgtcagcctccaccagggcccatcggtcttccccttggccaccctcctccaagacgcacctctc

SEQ ID NO: 531259 - DNA, 394 bp, Homo sapiens; identical to SEQ ID NO: 446347
  misc_feature: HEFZJCU01DNHB5.52.41.D08.1.454.heavy.3.raw

SEQ ID NO: 531260 - DNA, 509 bp, Homo sapiens
  misc_feature: HEFZJCU01D747Z.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaactgggtgcgccaggccgctggacaacgacctgagtggatgggatgggcgaaccctaacactggtgtcacagtgtcttcacccatcctccgggacagacttaccgatgaccacgaactcctccataaacacagcctacatggagttgaggagcctgacatctgacgatacggccgtctattactgtgcgagagtcccacgactccggtgacgcctacggcaggcggcctttgacttcgtc

SEQ ID NO: 531261 - DNA, 502 bp, Homo sapiens
  misc_feature: HEFZJCU01DDDGA.26.23.C01.1.454.heavy.3.raw
agactatactcacgaccggtgctcgatttagtacacgtgattagggattgggaggcgtggtccagcctggggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtccaccgtctcctcagcctccaccagggcccatcggtcttcccctggcgccctgctccaggagcacctccgagagcacagcggccctgggctgcctggtcaaggactacttccagtatagtct

SEQ ID NO: 531262 - DNA, 518 bp, Homo sapiens
  misc_feature: HEFZJCU01CB2Z4.40.39.D06.1.454.heavy.3.raw
tctagcgactcacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggactggatccgccagcccccagggaaggggctgggagtggattggggagtatttaccacagtgggagcacctactacaacccgtccctcaaaagtcgaggcaccatatcgtagacacgtccaagaaccaattctccctgagctgagctctgtgaccgccgcagacacggctgtctattactgtgcggacggccccgagcgcagtggtcgttttcgatgtcctttgtactatggtggggtaccgaaggggaccaagttggtaccg

SEQ ID NO: 531263 - DNA, 489 bp, Homo sapiens
  misc_feature: HEFZJCU01BRBI5.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttatcgaagcgatgggactcatgaacaatatgcagactccgtgaagggccgattcatcatctccagagacaactccaacaacacactggatctccaaatgaacagcctgagagtcgaggacaacggccgtactattattgtgtcccttgattacta

SEQ ID NO: 531264 - DNA, 500 bp, Homo sapiens
  misc_feature: HEFZJCU01C32OJ.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctctttttaagaggtgtccagtgtcaggtgcaactggaggagtctgggggaggcgtggtccagcctgggaggtccctgagactctcctgtacagcctctggcttcaccttcattacctatggcatgcactgggtccgccagactcccaggcagggggctggagtgggtggcagttatttcatatgatggaaatagtgacttctattcagactccgtgaaggccgattcaccgtctccagagacaattccaggcacacgctgtatctgcaaatgaacagcctgagagctgaggacacggctgtgtattactgtgtcgaaagatttctatagaggtgactacgggggcgttcg

SEQ ID NO: 531265 - DNA, 507 bp, Homo sapiens; identical to SEQ ID NO: 446827
  misc_feature: HEFZJCU01DC8AP.10.38.D05.1.454.heavy.3.raw

SEQ ID NO: 531266 - DNA, 509 bp, Homo sapiens
  misc_feature: HEFZJCU01CFQ9T.40.39.D06.1.454.heavy.3.raw
tctagcgactcacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgtatgtctttcgagtatggtggggcgaacgggaacaagtggtacg

SEQ ID NO: 531267 - DNA, 493 bp, Homo sapiens
  misc_feature: HEFZJCU01CGTUH.51.27.C05.1.454.heavy.3.raw
  modified_base (304)..(304): a, c, t, g, unknown or other
cgatcgtatacacgaccggtgctcgatttagacgcgatcgaagggtttggggagctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccnggctccaggcaaggggctggactgggtggcagggtatatcatatgatggaagcaataaatactacgcagactccgtgaagggccgattcaccatctccagagacagttccgatgacacagtcttatctgcaaatgaacagcctgagagctgaggacacggctcttttttactgtgcgccaggaagcagt

SEQ ID NO: 531268 - DNA, 520 bp, Homo sapiens
  misc_feature: HEFZJCU01BU4QI.48.8.A08.1.454.heavy.3.raw
agtatacatacacgaccggtgctcgatttagcatactctacagggggagtctccctcactgcccagctgggatctcagggcttcattttctgtcctccaccatcatggggtcaaccgccatcctcgccctcctcctggctgttctccaaggagtctgcgcggaagtgcgcctggtgcagtctggagcagtggtgaagaggcccggggagtctctaaagatctcctgtcagggttctgaaggcgactttgacaccttctgggtcgcctgggtgcgccagaggcccggtaaaggactagagtatatgggcgtcatctatcctggtgactccgataccatatatactccgtcgtttcaaggccaggtcaccatgtctgccgacaagtccaagactgtcgcctacctccactgggccaactgacgtcctccgacagcgccacttatactgtgcggagggtaggcactacgtcgttggggtcgagaggacaacgtggttcgaccccgtggggccgagggtaaccc

SEQ ID NO: 531269 - DNA, 511 bp, Homo sapiens
  misc_feature: HEFZJCU01AZLAL.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcaggggtcatcatgacggggacgacgtccatcgccacaacttacatggaactgaccagtctgacatttgacgacacggccgtctattactgtgcgacagaagcggcggacagaggttcgcttactggttcgaggctctccccacg

SEQ ID NO: 531270 - DNA, 512 bp, Homo sapiens
  misc_feature: HEFZJCU01BGGZQ.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacatgaccaacgtgaagcctgcggacacggccacatattattgtgcacaccgacgctataccgccagctgggaaatcgacaactggttcgacccctggggccaggggaaccctgtcaccgtctcctcagcctccaccaaggg

SEQ ID NO: 531271 - DNA, 512 bp, Homo sapiens
  misc_feature: HEFZJCU01CS7VU.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagcgatgacacggccgtgtattactgtgcgaggagataggggcccacgaacgttactacgctatggacgtcgt

SEQ ID NO: 531272 - DNA, 382 bp, Homo sapiens
  misc_feature: HEFZJCU01C8E8Z.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaatttccaggaacatactgattctgcagttgaccagactgagagtcggaggacacggccgtatattattgtgttaaatgggatggtggctacgactcttgggccggggaaccctggtcaccgtctctttcagcttccaccaagggcccaatcggtcttccccctggcgccctgctccaggagcacctctgggggcacagcggccctgggctgcctggtcaaggactacttcctacgtgagct

SEQ ID NO: 531273 - DNA, 499 bp, Homo sapiens
  misc_feature: HEFZJCU01CLPNV.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaaggggctggagtgggtctcatccattagtagtaatagtgcctacagatactacgcagactcactgaagggccgactcaccatctccagagacaacgccaagaactcactgtatctgcaatgaacagcctgagagccgaggacacggctgtgtattactgtgcgagaggagctattatctaggaaccccgatgtcttttg

SEQ ID NO: 531274 - DNA, 500 bp, Homo sapiens
  misc_feature: HEFZJCU01BWDKJ.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccagaactcactgtatctgcaaatgaacagcctgagagccgagacgacggctgtgtattactgtgcgagaggagctattatctcggaaccccgat

SEQ ID NO: 531275 - DNA, 524 bp, Homo sapiens
  misc_feature: HEFZJCU01AHYVL.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccacttaggtttgactacgtggggccaggggaagtcgttggtcaccgtctcctcacg

SEQ ID NO: 531276 - DNA, 518 bp, Homo sapiens
  misc_feature: HEFZJCU01EDUWP.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaaagaacacgatgtatctgcaaaatggacagcctaaagagttgaggacacggctgtttattactgtacgaaagaggggggatacagtggcagctccaagtactaactttgacttctggggccagggaaccctggtcaccgtctcctcagcctccaccaaggcccatcggtccttccccgtggccgcccgtgctcc

SEQ ID NO: 531277 - DNA, 524 bp, Homo sapiens
  misc_feature: HEFZJCU01CGTGI.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcggggcccacgaaccgttactacgctatggacgtcgtggggccaagggacccg

SEQ ID NO: 531278 - DNA, 510 bp, Homo sapiens
  misc_feature: HEFZJCU01BVQVU.40.81.H04.1.454.heavy.3.raw
  modified_base (469)..(469): a, c, t, g, unknown or other
  modified_base (478)..(478): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcgagggcagggtcaccatgacctggggacgcgtccatcagcacagtctacatggatctgagcgggactggaccctcgtcgacgacacggccatgtattactgtggaagngacgttggnggcgtccgcggggctggaccacgtggggccgg

SEQ ID NO: 531279 - DNA, 528 bp, Homo sapiens
  misc_feature: HEFZJCU01EQMSA.22.41.D08.1.454.heavy.3.raw
acatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttctaagggaaacacaaactatgcagagaggctccagggcagagtcaccatgaccgcagacacaccaacgaccacagccctacactggagttgaggagtctgagacctgacgacacggccgtatattactgcgcgagagggtcgtttcgtacggtgactatgagtatctcaggcacgtggggccgaggggcaccccgtggtctacg

SEQ ID NO: 531280 - DNA, 521 bp, Homo sapiens
  misc_feature: HEFZJCU01BWIOI.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaagggctggagtggattggggatatctcttatagtgggagtacgaactacaatccgtcctcaagagtcgagtcatcatatccgtagacaggtccaggaacgaattctccctgaaagtgagttctgtgaccgtcgcagacacggctgtctattattgtgcgagacggacaaatatggttcagggagttcgactacgtgggccagggaaccctggtcaccgtctcctcagcctccaccaacggg

SEQ ID NO: 531281 - DNA, 484 bp, Homo sapiens
  misc_feature: HEFZJCU01DFO12.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccatcgagaggtctagagtggctgggaaggacatatttcatgtccaacacgtggaatacaaattatgcaccatctgttgagagtcgactgacaatcaacgtagacacatcgaagaaccagttctccctgcagctgactctgtgactcccggaaggacacggggtgttagtatttactggtggaagtacgggccccc

SEQ ID NO: 531282 - DNA, 531 bp, Homo sapiens
  misc_feature: HEFZJCU01DUXUF.19.3.A03.1.454.heavy.3.raw
tactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccagggaaggggctggagtgggtctcttccattaataaacatgccagtgacatgtactacgcagacgcactggagggccgattcaccatctccagagacaaacgccaggagctcactgtttcttcacatgaacaacctgacccccgaggactacagctatatattattgtgggaggaagaaagagtggggggaggtcctcttgggccagggaacccgggtcgccgtcgtcccg

SEQ ID NO: 531283 - DNA, 518 bp, Homo sapiens
  misc_feature: HEFZJCU01DMAS3.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtggaggggccgattcagcatctccagagacaacggcaagagtatactgtatctggaaatgaacaatctgagagtcgacgatacggctgtctatcattgttgttttcgattgccttcggtccgcgggtacttcgtggggccacgggtaacccgtc

SEQ ID NO: 531284 - DNA, 504 bp, Homo sapiens
  misc_feature: HEFZJCU01C1DCV.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacaggacttaccatgaccacgaactcctccataaacacagcctacatggagttgaggagcctgacatctgacgacacggccgtctattactgttgcgagagtcccacgatccggtgagcctacggcagcggctttgacttctc

SEQ ID NO: 531285 - DNA, 508 bp, Homo sapiens
  misc_feature: HEFZJCU01DDV9Y.10.34.D01.1.454.heavy.3.raw
catagtagtgcacgaccggtgctcgatttagatcgtctgtgttgggtttggggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgcaggctccagggaaggggctggagtgggttggccatattaaaatcaaagctgatggtgggacaacagagcacgctgcacccgtgaaaggcaagattcagcatctacaagagatgaattacaaaaagtacgctgtatctgaacatgaacagcctagaaaacggaggacaacagccgtagtattactgtgccactcaaggaccgatattgtt

SEQ ID NO: 531286 - DNA, 515 bp, Homo sapiens
  misc_feature: HEFZJCU01C957T.49.42.D09.1.454.heavy.3.raw
agtcgagagacacgaccggtgctcgatttagacacatacgcagggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattggggagtatatattttactggggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcct

SEQ ID NO: 531287 - DNA, 509 bp, Homo sapiens
  misc_feature: HEFZJCU01CEM6V.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggcccagggaaccctggtcaccgtctcctcagcctccaccaagggcccatcggtcttccccctggcaccctcctccaagagcacctctgggggcacagcggcctgggctgcctggtcaggactacttcctacgtcgtat

SEQ ID NO: 531288 - DNA, 541 bp, Homo sapiens
  misc_feature: HEFZJCU01CSZ63.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatgggctgtgttttagttgggggtccaggggacgccctggtccaccggtt

SEQ ID NO: 531289 - DNA, 380 bp, Homo sapiens
  misc_feature: HEFZJCU01DM98G.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctcctgggggcacagcggcccctgggctgcctggtcaaggactacttcctacgtgagct

SEQ ID NO: 531290 - DNA, 576 bp, Homo sapiens
  misc_feature: HEFZJCU01CTGZV.40.16.B05.1.454.heavy.3.raw
tctagcgactcacgaccggtgctcgatttagagctcacgtaagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccagctacatccccctccctcgagagtcgagtcaccatttcactagacacgtccacaaatcagttgtccctgaggctgagctctgtgaccgccgcggacacgggcgtatattactgtgcgaggaggggggccggggggaaactccgtatggctcctttgactacgtggggccagggaaccccgtggtccgaccgtcctccctcacggccctcccaccaaacgggggccccaagttccgggtcctttccccccgtgggcccgtccccgtcggccttcccgagggacggtccgaccccg

SEQ ID NO: 531291 - DNA, 530 bp, Homo sapiens
  misc_feature: HEFZJCU01DG57H.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggaccacggctgtctattattgtgcgagagtaagtggtcatggtccttttgaccagtggggccgagggaaccctggtcaccgtctcctcagcttccaccacgggcccagtccggtcttccccctggccgccctcgcctccaggacgcacctcgtcgggggtcgacgacggcc

SEQ ID NO: 531292 - DNA, 501 bp, Homo sapiens
  misc_feature: HEFZJCU01EVODS.22.86.H09.1.454.heavy.3.raw
  modified_base (500)..(500): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctccaaatgaacagcctgagaggcgaggacacggcagtgtattactgtgcgagagatcgacatgactacgggaaagcttttagatctctgggccaaggggacactgtcaccgtctcttcacgcctccaccaaggcccatccggtcttcccctggccgacccgtnc

SEQ ID NO: 531293 - DNA, 518 bp, Homo sapiens
  misc_feature: HEFZJCU01C03EN.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaacccctcctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtccttccccctggctacccc

SEQ ID NO: 531294 - DNA, 486 bp, Homo sapiens
  misc_feature: HEFZJCU01A14VO.49.73.G07.1.454.heavy.3.raw
  modified_base (435)..(435): a, c, t, g, unknown or other
agtcgagagacacgaccggtgctcgatttagctctacgctcagggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctggggaggtccctgagactctcctgtgcagcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaatgaacagcngagagctagaagacacggctttatattactgtgacgaacttaatcacggac

SEQ ID NO: 531295 - DNA, 488 bp, Homo sapiens
  misc_feature: HEFZJCU01BTKRA.48.38.D05.1.454.heavy.3.raw
agtatacatacacgaccggtgctcgatttagtatctgatagttgggtttggggatcacagaacaaccacactcctcctctaaagaagcccctgggagcacggcgcatcaccatggactggacctggaggttcctctttgtggtggcagcagctacatgtgtccagtccctaggtgcagctggtgcagtctggggctgaagtgaagaagcctgggtcctcggtgagggtctcctgcaagacttctagagacaccttcaacagctatgctatcagctggggtgcgacaggcccctggacaaggtcttgagtggatgggagtaatcgtccctttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataagatagt

SEQ ID NO: 531296 - DNA, 521 bp, Homo sapiens
  misc_feature: HEFZJCU01D398U.49.80.H03.1.454.heavy.3.raw
agtcgagagacacgaccggtgctcgatttagctgtgcgtcgaagggaaaggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaagggggctggagtgggtggcagttatatcctatgatggaagcaataagcactacgcagagtccgtgaagggccgattgaccatctccagagacaactcgaagaatacggttcttctacaaatgaacaagcctgagagctgaggacgacggctatgttttactggttgacgaggaaggggaactacggattacaggtacagcccctacgg

SEQ ID NO: 531297 - DNA, 517 bp, Homo sapiens
  misc_feature: HEFZJCU01CLZW0.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctgaaatgaacaatctgagagtcgacgatacggctagtctatctattgtgttttcgatgccttcggtccgcgggtacttcgtgggggtccagggaacccttc

SEQ ID NO: 531298 - DNA, 520 bp, Homo sapiens
  misc_feature: HEFZJCU01DITB4.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggtttcccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaaggagtatactgtatctggaaatgaacatctgagagtcgacgatacggctgtctatcattgttgtttcgatcgcctttcggtccggcggtacttccgtggggcccgagggtaacccg

SEQ ID NO: 531299 - DNA, 514 bp, Homo sapiens
  misc_feature: HEFZJCU01A2AKO.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagccgaccggcagttagtcacccatactactttgactacgtggggaccg

SEQ ID NO: 531300 - DNA, 504 bp, Homo sapiens
  misc_feature: HEFZJCU01CIBXG.48.38.D05.1.454.heavy.3.raw
agtatacatacacgaccggtgctcgatttagtatctgatagttgggtttgggggctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccaggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggagtttcacctacacgac

SEQ ID NO: 531301 - DNA, 495 bp, Homo sapiens; identical to SEQ ID NO: 450151
  misc_feature: HEFZJCU01D6SIW.51.30.C08.1.454.heavy.3.raw

SEQ ID NO: 531302 - DNA, 493 bp, Homo sapiens
  misc_feature: HEFZJCU01AC6S1.53.62.F07.1.454.heavy.3.raw
  modified_base (440)..(440): a, c, t, g, unknown or other
cgcgtatacacacgaccggtgctcgatttagtagtcgcataaagggaaaggggtctgggagacgagcccagcactggaagtcgccggtgtttccattcggtgatcatcactgaacacagaggactcaccatggagtttgggctgagctgggtttttcctcgttgctctttttaagaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaatggacngtctgagaactgaagacacggctgtgtattactgtgcgagtgagatgtcttac

SEQ ID NO: 531303 - DNA, 498 bp, Homo sapiens
  misc_feature: HEFZJCU01DCBOH.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgcagtctccaggcaaggggctgcagtgggtggcgtttattcgaagcgatgggactcatgaacaatatgcagactccgtgaagggccgattcatcatctccagagacaactccaacaacacactggatctaccaaatgaacagcctgagagtcgaggacgacggccgtattattattggtcgtcccttggactttactagtgt

SEQ ID NO: 531304 - DNA, 508 bp, Homo sapiens
  misc_feature: HEFZJCU01DWJFW.47.48.E04.1.454.heavy.3.raw
  modified_base (427)..(427): a, c, t, g, unknown or other
  modified_base (454)..(454): a, c, t, g, unknown or other
  modified_base (475)..(475): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttcngacaaatggacagcctgagagtcgaanacacggctgtgtattactgtntgtctctgacgcctcggccggaccttggcttcg

SEQ ID NO: 531305 - DNA, 533 bp, Homo sapiens
  misc_feature: HEFZJCU01D0M5Q.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccggcgggggtccacccaaattgactactgggccgagggaacccgtggtcaccgtctcctcagcctccaccgaacgggcccatccggtcttccccctggccgccctgctccac

SEQ ID NO: 531306 - DNA, 522 bp, Homo sapiens
  misc_feature: HEFZJCU01DB91S.9.34.D01.1.454.heavy.3.raw
tgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtcccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccagttttatttctgtgcgaaggaggacatatagggaagtacgattttcgatcccctcgcc

SEQ ID NO: 531307 - DNA, 484 bp, Homo sapiens
  misc_feature: HEFZJCU01BI2YC.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctggggggaggcgtggtccagtctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagagatgacg

SEQ ID NO: 531308 - DNA, 542 bp, Homo sapiens
  misc_feature: HEFZJCU01DDZZC.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggaggtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgtgttttattgggggccaggggacgccctggtccaccg

SEQ ID NO: 531309 - DNA, 509 bp, Homo sapiens
  misc_feature: HEFZJCU01CJJZ2.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacaagtccgcgagcactgtctatatggagatgaggagcctgagacttgacgacacggccgtatattactgtgcgagaatcgaagaaggtggctacaatcacggagcttttgaagttttggggccaagggacaatggtcatcgtctcctcagcctccaccaagggcccatcggtcttcccctggcaccctcctccaagagcacctctggggcacacgcgccctggctgccg

SEQ ID NO: 531310 - DNA, 529 bp, Homo sapiens
  misc_feature: HEFZJCU01CTC0O.48.53.E09.1.454.heavy.3.raw
agtatacatacacgaccggtgctcgatttagagagagtgtgttgggtttgggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtgggtggtacttgcgaacccgggatactactccaaacttcggactttggacatcgtggggccaagggacctcc

SEQ ID NO: 531311 - DNA, 411 bp, Homo sapiens; identical to SEQ ID NO: 501785
  misc_feature: HEFZJCU01CAK1M.40.81.H04.1.454.heavy.3.raw

SEQ ID NO: 531312 - DNA, 507 bp, Homo sapiens
  misc_feature: HEFZJCU01C83NL.13.85.H08.1.454.heavy.3.raw
  modified_base (441)..(441): a, c, t, g, unknown or other
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctcggggcaaggtcttgagtggatgggactaatcactcccaatggtgatgggactgcctagcacagaagtttcagggcagagtcaccatgaccagggacacgtccacggagaacagactatttcggagttgagcagcctgagatcctgacacncggccgttttattactgttgcgcgagataatgtacacaactggaacgtcggtttttggggtggttc

SEQ ID NO: 531313 - DNA, 523 bp, Homo sapiens
  misc_feature: HEFZJCU01BR4YR.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggccaaggg

SEQ ID NO: 531314 - DNA, 527 bp, Homo sapiens
  misc_feature: HEFZJCU01D7371.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccaggggaaggggctggagtggggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggaactacaaacggacggtggtaccctggttaattc

SEQ ID NO: 531315 - DNA, 507 bp, Homo sapiens
  misc_feature: HEFZJCU01ER4BW.40.37.D04.1.454.heavy.3.raw
tctagcgactcacgaccggtgctcgatttagtagcatactgttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctggggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaatgaacgctgacagccgagacacggccaaatattactgtgtgaaggatcgaggaagtgggagctggtaggcc

SEQ ID NO: 531316 - DNA, 501 bp, Homo sapiens
  misc_feature: HEFZJCU01COL97.14.25.C03.1.454.heavy.3.raw
cgtctagtaccacgaccggtgctcgatttagtagtgtagatttgggtttgggggggaggacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattagtatcacatgatggaactaatagacgctatgccgactccgtgaagggccgattcaccatctccagagacaattccaagaacacgcagtatctgcaaatgaacagccctgagagctggaggacacggctgtgtattactgtgggagagatgggaggtcgatattgta

SEQ ID NO: 531317 - DNA, 524 bp, Homo sapiens
  misc_feature: HEFZJCU01BM69R.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaagtcgaggcaccatatccgtagacacgtccaagaaccaattctccctgaagctgagctctgtgaccgccgcagacacggctgtctattactgtgcgacggccccgagccgcagtgtcctttttgattcgtccgtttgattagttggtcgggggtaccgaacgggggactaagtggttaccg

SEQ ID NO: 531318 - DNA, 506 bp, Homo sapiens
  misc_feature: HEFZJCU01D7XQ7.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacagatacacacagagattccagggcagaatcacacttaccgcggacaaatccacgggcacagcgcagttggacctgagcgggcctgagacctggaggacacggccatttactactgtgcgcggggaggtgggcggagctcggttttcggagttatcatctactactttgt

SEQ ID NO: 531319 - DNA, 507 bp, Homo sapiens
  misc_feature: HEFZJCU01DABAY.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggatggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtacttac

SEQ ID NO: 531320 - DNA, 513 bp, Homo sapiens
  misc_feature: HEFZJCU01CWMIS.48.12.B01.1.454.heavy.3.raw
agtatacatacacgaccggtgctcgatttagtagtgtagattccgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatcccacgggcacagcgcagttggacctgagcggcctggagacctggaggacacgggccatttactactgtgcggcggggaggtggacggtagcttcgggttttacggagttatcattccgtact

SEQ ID NO: 531321 - DNA, 515 bp, Homo sapiens
  misc_feature: HEFZJCU01D20ZW.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagacgtatactggtatctggaaatgaacaatctgagagtcgacgatacggctgtctatcattgtgttttcgatgccttcggtccgcgggacttcgtggggtccagggaaccctc

SEQ ID NO: 531322 - DNA, 537 bp, Homo sapiens
  misc_feature: HEFZJCU01EELJG.16.87.H10.1.454.heavy.3.raw
  modified_base (479)..(479): a, c, t, g, unknown or other
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgacgacccgaggacacggctgtgtattactgtgcgaaggcagttcgnggaaacagttatgggttggggggaggttggggttttttttcgtttacttacgggtata

SEQ ID NO: 531323 - DNA, 486 bp, Homo sapiens
  misc_feature: HEFZJCU01DDKJ7.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggccctgtatttttgtgtcgagagagtctattaaagtggc

SEQ ID NO: 531324 - DNA, 551 bp, Homo sapiens
  misc_feature: HEFZJCU01EUEQ6.48.40.D07.1.454.heavy.3.raw
agtatacatacacgaccggtgctcgatttagtgatagagcgtaacaacagagggctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggacaccgcgctttattattgtacaacgtcgttttactttctaatggtggctcttacgaacgacatgactattggggtcggggaacccgtggtcaccgtctcctcagcctccaccaaggcccatcggtcttcccctggccaccctcctccaagagcacctctgggggc

SEQ ID NO: 531325 - DNA, 494 bp, Homo sapiens
  misc_feature: HEFZJCU01DB5UC.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcccgtgtacgagtacttacctctactcgtactagt

SEQ ID NO: 531326 - DNA, 516 bp, Homo sapiens
  misc_feature: HEFZJCU01DW77P.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactccctccataaacacagcctacatggagttgaggagcctgacatctgacgacacggccgtctagttactgtgcgagagtcccacgactccgggtgacgccctacggcaggccggtccttttggactttcgtc

SEQ ID NO: 531327 - DNA, 526 bp, Homo sapiens
  misc_feature: HEFZJCU01CGHX3.17.34.D01.1.454.heavy.3.raw
  modified_base (499)..(499): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcacctttcagcgactatagttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggataattactataacactgctcttttacacctcccttnacttctgggccatggaaccccggtccg

SEQ ID NO: 531328 - DNA, 520 bp, Homo sapiens
  misc_feature: HEFZJCU01ERTCF.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaaggacacctccacaaaccaggtggtccttacaatgaccaatatggaccctgtggacacagccacatattactgttcacgctctatggttcggggagttattagtccctactttgactactggggccagggactcgtggtcaccgtctccgcagcctccaccaaggggcccagtcc

SEQ ID NO: 531329 - DNA, 502 bp, Homo sapiens
  misc_feature: HEFZJCU01BOAO8.13.76.G10.1.454.heavy.3.raw
  modified_base (461)..(461): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtncgagagatggggcccacgaacgttactacgctatggacgtc

SEQ ID NO: 531330 - DNA, 513 bp, Homo sapiens
  misc_feature: HEFZJCU01B0VUV.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcggcatctccagagacaacggcaagagtatactgtatctggaaatgaacaatctgagagtcgacgatacggctgtctatcattgtgttttcgatgccttcgtccgcgggacttcgtgggcagggaaccctggtcg

SEQ ID NO: 531331 - DNA, 486 bp, Homo sapiens
  misc_feature: HEFZJCU01B5LOU.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggtttttcctcgttgctctttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaaggccgattcaccatctccagagacaattccaagaacacgctgtatctgcaaatgaacagcctgagagctgaggacacggactgtgtattactgtgcgaggcggt

SEQ ID NO: 531332 - DNA, 474 bp, Homo sapiens
  misc_feature: HEFZJCU01CIKUZ.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcgagggtcaccatgaccagggacacgtccatcagcacgtccatcagcacagcctacatggacctgagcggcctgacaatctgacgacacggccgtatatttctgt

SEQ ID NO: 531333 - DNA, 496 bp, Homo sapiens
  misc_feature: HEFZJCU01EJ2IE.40.81.H04.1.454.heavy.3.raw
  modified_base (452)..(452): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcaggtctggggctgaggtgaagaagcctggggcctcggtgaaggtctcctgcaagatttctggaaacaccctgagcaactactacatacactggatgcggcaggcccctggacaggggtttgagtggatgggggtggatcaaccctaccagaggtggcacaaagtatcgacagaactttcagggcagggtcaccatgacctgggacgcgtccatcagcacagtctacatggatctgagcggacgtggacctacgtgacgacacggccangtattactgtggaagagacgttggtggctacgcgggctgaccac

SEQ ID NO: 531334 - DNA, 515 bp, Homo sapiens
  misc_feature: HEFZJCU01CO0NP.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtagaagcctgcggacacggccacatattaattgtgcacaccgaacgctactaccgccagctgggaaatcgaacaactggttcgacccctggggcccaggggaacccttgtcaccgtctcctcagcctccacc

SEQ ID NO: 531335 - DNA, 531 bp, Homo sapiens
  misc_feature: HEFZJCU01D2ITX.48.57.F02.1.454.heavy.3.raw
agtatacatacacgaccggtgctcgatttagctcgatatagttgggtttgggggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgttacacacaccatcttgacgactggggatgcttttctatttctggggccgaggggaccgtggtcgccgtgtctacagcctccaccaacgggcccagtcggtccttccccctcgg

SEQ ID NO: 531336 - DNA, 509 bp, Homo sapiens
  misc_feature: HEFZJCU01DFED6.51.24.C02.1.454.heavy.3.raw
cgatcgtatacacgaccggtgctcgatttagtacagatcgttagggaaaggggctgggagaggagcccagcactagaagtcggcggtgtttccattcggtgatcagcactgaacacagacgactcaccatggactttgggctgagctgggttttcctcgttgctcttttaagaggtgtccactgtcaggtgcagttggtggagtctgggggaggcgcggtccagcctgggaggtccctgaggctctcctgcgcgtcctctggactccccttcagcacttatgacatgcactgggtccgccaggctccaggcaaggggctggagtgggtggcagtcatatcatatgatggaaaggataagtactatgcagactccatgaagggccgatccaccatctccagggacaattccaagaacacactgtatctgacaaaataaacaacctgagtagttgcggacacggctgtctattacttgtgcggcacgtgggggactacggtgacaacgtca

SEQ ID NO: 531337 - DNA, 502 bp, Homo sapiens
  misc_feature: HEFZJCU01AJXDG.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgacaaatgaacagcctgagagctgaggacacggctgtgtattactgtgcgaaagatttctataggaggtcgacgtac

SEQ ID NO: 531338 - DNA, 534 bp, Homo sapiens
  misc_feature: HEFZJCU01DEVNV.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggtcttgttctggggccgacgggggaccctggtcatcgtctccccacgtccctcccaccaacgggacccacgtccggttccttccccct

SEQ ID NO: 531339 - DNA, 510 bp, Homo sapiens
  misc_feature: HEFZJCU01CSG4L.17.25.C03.1.454.heavy.3.raw
  modified_base (353)..(353): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaacccntcctccgggacagacttaccatgaccacgaactcctccataaacacagcctacatggagttgaggagcctgaccatctgacgacacggccgtctattactgtgcgagagtcccagatccggtgagcctacggccaggcggcctttggtacttccgtc

SEQ ID NO: 531340 - DNA, 504 bp, Homo sapiens
  misc_feature: HEFZJCU01B9G65.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgtagtttggttgggcggggatagcagcgggtaccc

SEQ ID NO: 531341 - DNA, 510 bp, Homo sapiens
  misc_feature: HEFZJCU01ERJRV.51.25.C03.1.454.heavy.3.raw
cgatcgtatacacgaccggtgctcgatttagtagtgtagatttgggtttggggtctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggggctggtccagcctgggaggtccctgagactctcctgtgcaggctctgcatttcccttcagtaactacgctatcgattgggtccgccaggctccaggcaagggactggagtgggtggcagttatttcagctgatggaggcaataagttttacggagattctgcgaggggccgattcaccatatccagagacaactccccaagataatgatatatactgcaaatgaacagcctgagacctgaggacacggctatcgtattatttgtgtcgtctagggggcgagtgcctggccaccgtgt

SEQ ID NO: 531342 - DNA, 553 bp, Homo sapiens
  misc_feature: HEFZJCU01EKELM.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgacttacgtggggtccgagggaaccctggtaccaccggtcctccgtccacgcctccctacccaacgggaccccg

SEQ ID NO: 531343 - DNA, 538 bp, Homo sapiens
  misc_feature: HEFZJCU01CM6PI.17.28.C06.1.454.heavy.3.raw
  modified_base (370)..(370): a, c, t, g, unknown or other
  modified_base (526)..(526): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataagcaagatggaactgccgagttttacgnggactcgtgtgaagggtccgtttcaccatctccagagacaacgccaagaattcactgtatctacaactgaacagcctgagagtcgcagacacggccgtgtattactgtgcgagatgtaggaaaagtatggctgtgtttattgggggccaggggacnccctggtcaccg

SEQ ID NO: 531344 - DNA, 519 bp, Homo sapiens
  misc_feature: HEFZJCU01DFBDZ.3.85.H08.1.454.heavy.3.raw
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcggtggtggtaacacatactacgcagactccgtgaagggccgcttcaccatctccagagacaattccaagaacacgctgcatctgcaaatgaacagcctagagagccggaggaccaccgggcccttttaattacctgtgacgaaaccaatcacgtataactggaactacggttaa

SEQ ID NO: 531345 - DNA, 523 bp, Homo sapiens
  misc_feature: HEFZJCU01EXXND.40.42.D09.1.454.heavy.3.raw
tctagcgactcacgaccggtgctcgatttagacacatacgcagggaaaggggcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaaccctggggcctcagtgaaggtttcctgcaaggcatctggatacaccttcaccaggtattttatgcactgggtgcgacaggccccgggacaagggcttgagtggatgggcataatcaacccaagtggtggtagcacaacctacacacagaagttccagggcagagtcaccgtgaccagcgacacgtccacgactacagtctacatgcaactgagcagcctgaggttcctgaggacgacggccggtgtatttacgtggtcgcgaagagaagttgaacttactaggttggtttaacttaactttaaaataaggccttacg

SEQ ID NO: 531346 - DNA, 508 bp, Homo sapiens
  misc_feature: HEFZJCU01DCLOY.48.38.D05.1.454.heavy.3.raw
agtatacatacacgaccggtgctcgatttagtatctgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgaacgaccggaccgtccgttattatttagttctacgaggataatacgtcgtcgtaagtaaagtaagtaacg

SEQ ID NO: 531347 - DNA, 535 bp, Homo sapiens
  misc_feature: HEFZJCU01D41IQ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagattctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagcgatgacacggccgtgtattactgtgcgagagagtggggcccgaccgaaccgtttactaacgtctaatcggacgtcgttcgggggccgaacggggaaccc

SEQ ID NO: 531348 - DNA, 519 bp, Homo sapiens
  misc_feature: HEFZJCU01EZ0Z0.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggccacgaacgttactacgctatggacgtctggggccgaagggaccg

SEQ ID NO: 531349 - DNA, 519 bp, Homo sapiens
  misc_feature: HEFZJCU01EEMY6.9.34.D01.1.454.heavy.3.raw
  modified_base (474)..(474): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcggaaaggaggcatatgggaagtacgatttttcgatccctccgcagtcgacactttgattactggggccggggaaccctggtcgccgtctcctcagcctccaccaaggcccatcggtcttcccctggcaccctcctccaagagcacctctgggggcncagcgccctgggctgcctggtcaaggactacttccagacgtatca

SEQ ID NO: 531350 - DNA, 521 bp, Homo sapiens
  misc_feature: HEFZJCU01BRWSW.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttcttgtgcgaaggaggcatatgggaagtacgattttcgatccctccgcagtcgacactttgattactggggccggggaacctggtcgccgtctcctcagcctccaccaagggcccatcggtcttccccctggcaccctcctccaagagcacctctgggggcacagcggcccgtggctgcctggtcaaggactacttcccagacgtatcac

SEQ ID NO: 531351 - DNA, 485 bp, Homo sapiens
  misc_feature: HEFZJCU01DCUWS.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgaccacgtccgcgagcactgtctatatggagatgaggagcctgagacttgacgacgacggaccgtatattactagtgcgagaatgagaaggtgctac

SEQ ID NO: 531352 - DNA, 533 bp, Homo sapiens
  misc_feature: HEFZJCU01C70X3.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatcctgcaaatagacagcctgagaccagacgacacggctgtctattattgcgcgagagagacacacgaacctactggccaatactatgggggcttgttctgggggccaggggaccctgggtcatcgtctcccccagccctccaccaacgggcccatcggtcttccccctggcgcctcg

SEQ ID NO: 531353 - DNA, 518 bp, Homo sapiens
  misc_feature: HEFZJCU01CW4ZD.53.57.F02.1.454.heavy.3.raw
  modified_base (414)..(414): a, c, t, g, unknown or other
  modified_base (430)..(430): a, c, t, g, unknown or other
  modified_base (446)..(446): a, c, t, g, unknown or other
  modified_base (463)..(463): a, c, t, g, unknown or other
cgcgtatacacacgaccggtgctcgatttagctcgatatagttgggtttgggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaaagtaagaaatactatgtagactccgtgaagggccgattcaccatctccagagacaattccaanatacgctgtatctgcncatgaacagcctgagngccgaagacgacgggtntttattactgtgcgaattaattacggaggacaaccggtacccccgtacgcgtacc

SEQ ID NO: 531354 - DNA, 536 bp, Homo sapiens
  misc_feature: HEFZJCU01DC2XV.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaagggctggagtgggttggccgcatcaagaggagataatgaaggggaggcgacagactacgctgcacccgtgagaggcagatttaccatgtcaagagaatgattcacaaagtacagtgtatctgcaaaatgaaacagcctgaagaccgaggacacagccatttactaattgtacaaatgaatactggggacgggggaaaattggggcagggaacctggtctccgtctcgtcag

SEQ ID NO: 531355 - DNA, 511 bp, Homo sapiens
  misc_feature: HEFZJCU01CP634.11.57.F02.1.454.heavy.3.raw
  modified_base (345)..(345): a, c, t, g, unknown or other
  modified_base (486)..(486): a, c, t, g, unknown or other
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccncaggctccaggtaagggctggaatggatttcatacattagcagtagtggtgcgaccatatactacgcagactctgtgaagggccgattcatcatcctcagagacaagtggacaacactcactgtatcgtaggaaatcaacngcctagagagtcgaggacacggctt

SEQ ID NO: 531356 - DNA, 495 bp, Homo sapiens
  misc_feature: HEFZJCU01ETZRO.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgagacacggctgtgtattactgtgcgaagatttctatagagtgacgtacgggggcgttcg

SEQ ID NO: 531357 - DNA, 504 bp, Homo sapiens
  misc_feature: HEFZJCU01BXIUN.40.81.H04.1.454.heavy.3.raw
tctagcgactcacgaccggtgctcgatttagtagtgtagattcgcggggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactggacctacgtcgaccgacacggcatgtattactgtcggaagagacgtggtggcgtacgcggggctcgaccactgggg

SEQ ID NO: 531358 - DNA, 514 bp, Homo sapiens
  misc_feature: HEFZJCU01BNW9V.12.25.C03.1.454.heavy.3.raw
  modified_base (511)..(511): a, c, t, g, unknown or other
atacgacgtacacgaccggtgctcgatttagtagtgtagatttgggtttggggacccaaaaaccacaccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggccagactcaccatgaccaccagacacatcagcgaacacagtcaacatggagttgcggagcctgcgatctgacgacgcggccgtatattactgttgcgagagtacgtagcggctcgtcctttgactctgggcctgggactctggtcaccgtntcc

SEQ ID NO: 531359 - DNA, 518 bp, Homo sapiens
  misc_feature: HEFZJCU01C5YEV.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtgcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggagggggaacagcgggagtccaagtactccttgacgtctc

SEQ ID NO: 531360 - DNA, 487 bp, Homo sapiens
  misc_feature: HEFZJCU01EQ5TF.13.86.H09.1.454.heavy.3.raw
tcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacaagactatggacagaacctccagggcagattcaccatgacgacagacacatacacgaacacagcctacatggaggtgaggagcctgagatatgacgacacggccgtgtattattgtgcgagagtggagtggcagtggatatcgaacaaattactactattacatggacgtctggggcaaac

SEQ ID NO: 531361 - DNA, 537 bp, Homo sapiens
  misc_feature: HEFZJCU01DF6EN.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactccctgaaagcgtcaactactactactacggtatggacctcgtggggaccg

SEQ ID NO: 531362 - DNA, 524 bp, Homo sapiens
  misc_feature: HEFZJCU01DX7JS.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtggggtggcactttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggggacctggtcatcgtctccccagcctccaccagggcccagtcggtccttcccctggcg

SEQ ID NO: 531363 - DNA, 494 bp, Homo sapiens
  misc_feature: HEFZJCU01DY2JX.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggccagggaaccctggtcaccgtctcctcagcctccaccaaggcccatcggtcttcccctggcaccctcctccaagagcacctctgggggcacagcggccctgggctgcctggtcaaggactacttccgagtagtaca

SEQ ID NO: 531364 - DNA, 522 bp, Homo sapiens
  misc_feature: HEFZJCU01BDMXV.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagtcttttgatctctggggccaagggacactggtcaccgtctcttcagcctccaccaacgggacccacgtcggtcctttcccccgtcggtccgccctggcctccgaggacg

SEQ ID NO: 531365 - DNA, 516 bp, Homo sapiens
  misc_feature: HEFZJCU01BF3TF.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggatttttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttatttctgtgcaaaggtggaaccgacatatttcacaagctggcactggtacttcg

SEQ ID NO: 531366 - DNA, 539 bp, Homo sapiens
  misc_feature: HEFZJCU01C5NVW.17.28.C06.1.454.heavy.3.raw
  modified_base (446)..(446): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccaggaaggggctggagtggtggccaacataaagcaagatggaactgccgagttttacgtggactctgtgaagggccgtttcaccatctccagagacaacgccaagaattcactgtatctacaactgaacagcctgngagtcgcagacacggccgtgtattactgtgcgagatgtggaaaaagtaatggctgtgttttattgggggccaggggacgccctggtctacccg

SEQ ID NO: 531367 - DNA, 508 bp, Homo sapiens
  misc_feature: HEFZJCU01CZYTC.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatggacagcctgagagccgaggacacggccgtatattactgtgcgaagcttagcggttaccggctacgattggggagcgactggttcgacccctggggccagggaaccctggtcaccgtctcctcagcctccaccaagggcccatcgtcttcccctggcaccctcctccaagagcacctctgggggcacagcggccctgggctgcctggtcaaggactacttcctacgtcgtat

SEQ ID NO: 531368 - DNA, 501 bp, Homo sapiens
  misc_feature: HEFZJCU01EO5JL.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagcgtgggggacacgggctgtgtattactgtggcgaggaggcgggctgggacctaactac

SEQ ID NO: 531369 - DNA, 515 bp, Homo sapiens
  misc_feature: HEFZJCU01EHGHP.40.9.A09.1.454.heavy.3.raw
tctagcgactcacgaccggtgctcgatttagcgagacgcgcaggggaggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcgactctgtgaagggccgattcaccatttccagagacaacgccaagaagtcactctctctacacatgaccagcctgacagccgaagacacggctgtttattactgtgcgagagatggcacgtcgggggcggtgactttgactacgtggggcc

SEQ ID NO: 531370 - DNA, 517 bp, Homo sapiens
  misc_feature: HEFZJCU01ED4YS.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactaacaacccgtccctcgagagccgagtcaccatgtcagtagacacgtaccaagaaccagttctccctgagggtgagctctgtgaccgccgcggacacgctgtgtacttctgtgcgagaggcaattttggactcgtcattctcctttgtacttcgtcggggccagggaaccctagtccaccgtcg

SEQ ID NO: 531371 - DNA, 514 bp, Homo sapiens
  misc_feature: HEFZJCU01A7USI.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatcccgggtgagccctacggccaggcggtccttttgacctttcgtc

SEQ ID NO: 531372 - DNA, 525 bp, Homo sapiens
  misc_feature: HEFZJCU01EYF8P.48.5.A05.1.454.heavy.3.raw
  modified_base (483)..(483): a, c, t, g, unknown or other
  modified_base (523)..(523): a, c, t, g, unknown or other
agtatacatacacgaccggtgctcgatttagatagatagacagggggagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttcttgcaaatgaacagcctgagagtcgacgacacggccgtatactactgtgcgagacagatgctgccncctgttccggtgggccaggaccctggtcaccgtctcctcncg

SEQ ID NO: 531373 - DNA, 536 bp, Homo sapiens
  misc_feature: HEFZJCU01B6L5O.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttatttttgtacgagagcgtcgtctgtcagtggaattgactactggggccagggaaccctggtcaccgtctcctcagcctccaccgaaggccc

SEQ ID NO: 531374 - DNA, 519 bp, Homo sapiens
  misc_feature: HEFZJCU01B8P8D.16.86.H09.1.454.heavy.3.raw
  modified_base (413)..(413): a, c, t, g, unknown or other
  modified_base (496)..(496): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgnggaccacggccgtgtattactgtgcgagagacccctccgatagcagtggctggccactaggttgactactggggccagggaancttggtcaccgtctcctcagcct

SEQ ID NO: 531375 - DNA, 497 bp, Homo sapiens
  misc_feature: HEFZJCU01BPGJE.26.71.G05.1.454.heavy.3.raw
agactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggatctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagacccgggtggtccttacaatgaccgacatgaatcctgtggacacaggcacatattactgtgcacacagtcctagcggctacgcaagaaagaatatgactattggggccagggaagttttggtcaccgtctccccagcct

SEQ ID NO: 531376 - DNA, 493 bp, Homo sapiens
  misc_feature: HEFZJCU01CT8M8.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtgcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggc

SEQ ID NO: 531377 - DNA, 473 bp, Homo sapiens
  misc_feature: HEFZJCU01CYIHU.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccatctcctcagcctccaccaagggcccatcggtcttccccctcggcaccctcctccaagagcacctctgggggcacagcggcctgggctgcctggtcaaggactacttccgagtagtaca

SEQ ID NO: 531378 - DNA, 396 bp, Homo sapiens; identical to SEQ ID NO: 444469
  misc_feature: HEFZJCU01CER98.47.46.E02.1.454.heavy.3.raw

SEQ ID NO: 531379 - DNA, 507 bp, Homo sapiens
  misc_feature: HEFZJCU01A4401.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgactatttgacgacacggccgtctattactgtgcgacagaagcggcggacaggagttcgcttactggttcgaggct

SEQ ID NO: 531380 - DNA, 511 bp, Homo sapiens
  misc_feature: HEFZJCU01C3210.22.86.H09.1.454.heavy.3.raw
  modified_base (503)..(503): a, c, t, g, unknown or other
acatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggccgccctcgccncgaggacg

SEQ ID NO: 531381 - DNA, 497 bp, Homo sapiens
  misc_feature: HEFZJCU01BHXVE.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactggtccgccaggctccaggaagggctgcagtgggtttcacacattaatactggaagtaggaccataacttacacagactctgtgaagggccgattcaccacctccagagacgacgccaagaactcactgtctctgcaatgaacagcctgagagtcgaggacacggctgtgtattactgtgcgagagatccggagggggacgtatgacc

SEQ ID NO: 531382 - DNA, 438 bp, Homo sapiens
  misc_feature: HEFZJCU01EL0S9.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttatttactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 531383 - DNA, 484 bp, Homo sapiens
  misc_feature: HEFZJCU01DDUMH.48.53.E09.1.454.heavy.3.raw
agtatacatacacgaccggtgctcgatttagagagagtgtgttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttaatggtggataaagccacgagcacagtctacatgcagctgagcagcctgagacacaacgacacggccgtctattattgttccagagataatcgcgtgaataaagat

SEQ ID NO: 531384 - DNA, 536 bp, Homo sapiens
  misc_feature: HEFZJCU01AF4I3.16.87.H10.1.454.heavy.3.raw
tgtactactccacgaccggtgctcgatttagcagtactgcgttgggtttgggggccccgagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccaggaaggggctggtgtgggtctcacatatttaatcttcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagtttgggttttttttcgttacgttacggtagtt

SEQ ID NO: 531385 - DNA, 488 bp, Homo sapiens
  misc_feature: HEFZJCU01D8BMW.3.75.G09.1.454.heavy.3.raw
  modified_base (472)..(472): a, c, t, g, unknown or other
agacgcactccacgaccggtgctcgatttagtatagacatcagggggacactgagtgtgagtgaacatgagtgagcaaaactggatttgtgtgccatttttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtagtattactgtgcgagagagggtttcgcagctcgtccggcgggcccagttgaacntgactatcactactac

SEQ ID NO: 531386 - DNA, 494 bp, Homo sapiens
  misc_feature: HEFZJCU01CND4A.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagacgtctgtgaagggccgattcatcatctccagagacaatggcaacaactcactgtatctggaatcaacagcctgagagtcgaggacacggctgtatattattgtgcgagacgcccctacggt

SEQ ID NO: 531387 - DNA, 506 bp, Homo sapiens
  misc_feature: HEFZJCU01AGZAY.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtatactgttcgagacgggctagtcgtgggatctagttatagtgactcgtcgtttcgtggggacccg

SEQ ID NO: 531388 - DNA, 306 bp, Homo sapiens; identical to SEQ ID NO: 493171
  misc_feature: HEFZJCU01E1CLW.51.85.H08.1.454.heavy.3.raw

SEQ ID NO: 531389 - DNA, 526 bp, Homo sapiens
  misc_feature: HEFZJCU01DDUPT.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacatgtatcttacaatgaataacctgagagccgaggacacggccatgtattactgtgtgggctatttactgaccctggggccgggaaccgtggtcaccgtctccccaccctccaccg

SEQ ID NO: 531390 - DNA, 504 bp, Homo sapiens
  misc_feature: HEFZJCU01BJB0G.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtggaagggccgattcaccgtctcccagagacaattccaggcacacgctgtatctgcaaatgaacagcctgagagctgaggacgacggctgtgttattactgtgcgaaagatttactatagaggtgacgtac

SEQ ID NO: 531391 - DNA, 523 bp, Homo sapiens
  misc_feature: HEFZJCU01AEMHA.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagagtggggcccacgaacgttactacgctatggacgtcgtggggccgaagggaccg

SEQ ID NO: 531392 - DNA, 484 bp, Homo sapiens
  misc_feature: HEFZJCU01AQKXS.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagaggggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 531393 - DNA, 535 bp, Homo sapiens
  misc_feature: HEFZJCU01D1UVT.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctagagaccaggacgacacggctgtctattattgcgcgagagagacacacgaacctactggccaatactatgggggctttgttcttggggccagggggaccctggtcatcgtctccccagcctccaccaagggcccatcggtccttcccctcggtccgcctcg

SEQ ID NO: 531394 - DNA, 506 bp, Homo sapiens; identical to SEQ ID NO: 444696
  misc_feature: HEFZJCU01BFT88.16.34.D01.1.454.heavy.3.raw

SEQ ID NO: 531395 - DNA, 529 bp, Homo sapiens
  misc_feature: HEFZJCU01EXN1F.53.33.C11.1.454.heavy.3.raw
cgcgtatacacacgaccggtgctcgatttagagtgagctcgttgggtttggggggaagaggaagactgacggtcctcccaggagttcaggtgctgggcaccgtgggcatgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccgtgggccacgggaacctggtcaccggtctcctcacgcttccaccgaacgggcccatccggtcctttcccccgtggtccgccctcgctccacggacgctacccg

SEQ ID NO: 531396 - DNA, 531 bp, Homo sapiens
  misc_feature: HEFZJCU01D5NRX.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatcggggcccacggtaacgttactacgctatggacgtcgtggggccaagggaccacc

SEQ ID NO: 531397 - DNA, 496 bp, Homo sapiens
  misc_feature: HEFZJCU01EF83W.49.17.B06.1.454.heavy.3.raw
agtcgagagacacgaccggtgctcgatttagtcgatagtgaagggggctctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctggaggacgacggctcttcttttacttgttgcgccaggaagcaggtggcgtc

SEQ ID NO: 531398 - DNA, 530 bp, Homo sapiens
  misc_feature: HEFZJCU01B6GX8.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctcggcgccctcgctccacggagcacctccgagagcacagcggccctcgggctgctggtcaaggactacttccacg

SEQ ID NO: 531399 - DNA, 511 bp, Homo sapiens
  misc_feature: HEFZJCU01DLIGB.48.28.C06.1.454.heavy.3.raw
agtatacatacacgaccggtgctcgatttagagctcacgtattgggtttggggtctgtgttgggtttggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggagtgtggtccagcctgggaagtccctgacactgtcctgcgcagcctctggattcaccttcaccacctttcgtatgcactttgtccgccaggctccaggcaaggggctggagtgggtgctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtcgagtttaacacgtcc

SEQ ID NO: 531400 - DNA, 527 bp, Homo sapiens
  misc_feature: HEFZJCU01AOQTE.3.6.A06.1.454.heavy.3.raw
agacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttactactactggagttggatccggcagtccccagggaagggactagagtgggttggccatatgcatcacagtgggagcaccaactacaacccctccctcgagagtcgagtcaccatatcaatagacacgtccaagaaccagttctccctgagcttgaagtctgtcaatgctgcggacacggccgtttattactgtgcagtactgcgggggaaagatccatttgatagttttggggcctaaggaacaatggtcaccgtcttcttcacgcctccaccgaacgggcccc

SEQ ID NO: 531401 - DNA, 488 bp, Homo sapiens; identical to SEQ ID NO: 447890
  misc_feature: HEFZJCU01BL8ZB.3.48.E04.1.454.heavy.3.raw

SEQ ID NO: 531402 - DNA, 510 bp, Homo sapiens
  misc_feature: HEFZJCU01BCN5C.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccggcaaattatgcacaggagtttcggggcagggtcgtcatgaccggggacacgtccatccgccacgacttacatggaactgaccagtctgacatttgacgacacggccgtctattctagtgcgacagaagcggcggacagaggtcgcttactggttcgaggctccc

SEQ ID NO: 531403 - DNA, 525 bp, Homo sapiens
  misc_feature: HEFZJCU01B8KOT.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctctttttatttatagtagtggtagtacatactccgcagactccgtgaggggccgattcaccatctccagagacaattccaagaacacgctgtttctcaatgaacagcctgagagccgatgacacggccgtgtattactgtgcgagagatcggggacccacggaacgttactacgctactggacgtctgggggccaaggggtacccg

SEQ ID NO: 531404 - DNA, 479 bp, Homo sapiens
  misc_feature: HEFZJCU01AN7US.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccagagcacctccgagagcacagcggccctgggctgcctggtcaaggactacttccacgcgtatgt

SEQ ID NO: 531405 - DNA, 541 bp, Homo sapiens
  misc_feature: HEFZJCU01DJP8Y.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctgggagtgggtctcctttatttacagcagtggtagtacatattccgcagactccgtgaggggccgattcaccatcctccagagacaactctaagaacacgctgtttcttcaaatgaacagcctgagagccgatgacacggccgtgtatttactggtgcggagagagtgggggcccacgaacgttacgtacgctatgggacgtcgtcgggggtccaagggaccctac

SEQ ID NO: 531406 - DNA, 489 bp, Homo sapiens
  misc_feature: HEFZJCU01DNT3Z.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcacatctccagagacaactccaagaacactctgtttctccaaatgaacagcctgagaggcgaggacacggcagtgtattactgtgcgagagatcgacatgtaacgg

SEQ ID NO: 531407 - DNA, 515 bp, Homo sapiens
  misc_feature: HEFZJCU01EJ9DS.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctgggggccaagggaccacggtcatcgtctccccagcctccaccaagggcccatcggtcttcccctggccgccctgctccaggagcacc

SEQ ID NO: 531408 - DNA, 534 bp, Homo sapiens
  misc_feature: HEFZJCU01BANAT.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttactacctcccttgtacttctggggcctatcggtaacccggtccg

SEQ ID NO: 531409 - DNA, 556 bp, Homo sapiens
  misc_feature: HEFZJCU01A7N37.15.86.H09.1.454.heavy.3.raw
  modified_base (480)..(480): a, c, t, g, unknown or other
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaaagtaaaatgatggtgagaaatagactacggtgcacccgtgaaaggaagattcaccatctcaagagataattacaaaacgacggtgtatttgcaaatgaacagcctagaaaaccgaggacacagccgtctattactgtaccanacgattcgggaagtgcatcggacgtaaaggaggactatgtcttttgattattcgtcggggcccgaggggacaagtc

SEQ ID NO: 531410 - DNA, 487 bp, Homo sapiens
  misc_feature: HEFZJCU01EDXKP.3.75.G09.1.454.heavy.3.raw
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagagagggtttcgcagctcgtccggcgggcccgagttgaacatgactatcactactac

SEQ ID NO: 531411 - DNA, 512 bp, Homo sapiens
  misc_feature: HEFZJCU01CX05W.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaacaggctcaccatcgccatggacacctccaaaaacaggtggtccttaaaatgaccaacatggacccaatggacagcgcgacatattactgtgccacaccattgatttgtggtcccaccaggtcgtcccgggccctttgatatctggggccgggggacagttcgtcaccgtctctgcagcctccaccaagggccc

SEQ ID NO: 531412 - DNA, 535 bp, Homo sapiens; identical to SEQ ID NO: 448705
  misc_feature: HEFZJCU01CM9QY.17.28.C06.1.454.heavy.3.raw

SEQ ID NO: 531413 - DNA, 519 bp, Homo sapiens; identical to SEQ ID NO: 450336
  misc_feature: HEFZJCU01CXZFL.17.33.C11.1.454.heavy.3.raw

SEQ ID NO: 531414 - DNA, 502 bp, Homo sapiens
  misc_feature: HEFZJCU01B6KMR.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggaggcctggtcaagcctggggggtccctgagactctcctgcgcagcctctggattcaccttcagtagttatagcatgaactggggtccgccaggctccagggaaggggctggagtgggtctcatccattagtagtaataggtgcctacagatactacgcagactcactggaagggccgactcaccatctccagagacaacgccaagaactcactgtatctgcaatgaacagcctgagagcgaggacacggctgtgtattacgtgtgcgagaggagctattatctaggaaccccgat

SEQ ID NO: 531415 - DNA, 529 bp, Homo sapiens
  misc_feature: HEFZJCU01DAXHG.48.4.A04.1.454.heavy.3.raw
agtatacatacacgaccggtgctcgatttagagtagtgatcaggggagtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggagttggggaaatcaatcatggtggatacaccaactacaacccgtccctcaagagccgagtcaccatcttagtggacacggcgaagaaccagttctccctcgaaactgaccgctgtgaccgccgcggacacggctgtgtattactgtgtcgagacgaatgggcgggtggctacgacttgacttttggggccaggggaaacctggtcaccgtcctcccccagcctttccaccaacggggcccatcggtt

SEQ ID NO: 531416 - DNA, 497 bp, Homo sapiens
  misc_feature: HEFZJCU01C287K.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggccgccctgctccaggagcacctc

SEQ ID NO: 531417 - DNA, 495 bp, Homo sapiens
  misc_feature: HEFZJCU01CMHRG.49.23.C01.1.454.heavy.3.raw
agtcgagagacacgaccggtgctcgatttagtacacgtgattagggattggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgacacagcctacatggaactgcgcagcctaggatctgccgacacgggccgtatatttctgtgcgagagagatgtctttctatgatagtactagtcattat

SEQ ID NO: 531418 - DNA, 496 bp, Homo sapiens
  misc_feature: HEFZJCU01DX66E.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacgacggcccacctattattgtgcgcgacatgactacgctcaattc

SEQ ID NO: 531419 - DNA, 529 bp, Homo sapiens
  misc_feature: HEFZJCU01CCRRC.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggattgactactggggccagggaaccctggtcacgtctcctcagcctccaccacggg

SEQ ID NO: 531420 - DNA, 509 bp, Homo sapiens
  misc_feature: HEFZJCU01CHQ3K.11.57.F02.1.454.heavy.3.raw
  modified_base (459)..(459): a, c, t, g, unknown or other
cgagagataccacgaccggtgctcgatttagctcgatatagttggggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctgggaatggatttcatacattagcagtagtggtgcgaccatatactacgcagactctgtgaagggccgattcatcatctccagagacaatggnaacaactcactgtatctaggaatcaacagcctgagagtcgaggaacacgg

SEQ ID NO: 531421 - DNA, 503 bp, Homo sapiens
  misc_feature: HEFZJCU01AGMZ7.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactgggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgtcttttgatatcgtggggcaaggggac

SEQ ID NO: 531422 - DNA, 555 bp, Homo sapiens
  misc_feature: HEFZJCU01DXUEQ.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgagtagcaggtggtctggggtcccaacgttaggttttgacgttaccgtgggggcccagggggaagcgtttgggtccaacccggtctccctccacgtccctcccg

SEQ ID NO: 531423 - DNA, 502 bp, Homo sapiens
  misc_feature: HEFZJCU01CMI7T.14.55.E11.1.454.heavy.3.raw
  modified_base (482)..(482): a, c, t, g, unknown or other
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagangggagggggtggtagatcca

SEQ ID NO: 531424 - DNA, 502 bp, Homo sapiens
  misc_feature: HEFZJCU01CVAHE.4.26.C04.1.454.heavy.3.raw
  modified_base (463)..(463): a, c, t, g, unknown or other
  modified_base (468)..(468): a, c, t, g, unknown or other
agcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgaccctggggccagggaacccatgtcaccgtctcctcagcctccaccaacgggcccatcggtcttcccctcggcgccctcgctccaggagcacctccgagaacacagcggcccngggcngcctggtcgaaggactacgttccctacacgtgct

SEQ ID NO: 531425 - DNA, 511 bp, Homo sapiens
  misc_feature: HEFZJCU01AGPIQ.49.22.B11.1.454.heavy.3.raw
  modified_base (480)..(480): a, c, t, g, unknown or other
  modified_base (509)..(509): a, c, t, g, unknown or other
agtcgagagacacgaccggtgctcgatttagacgacagctcagggggctctgggagaggagccccagccctgagattctcaggtgtttcctttcagtgatcagcactgaccacagaggactcaccatggaattgggactgagctggattttccttttggttattttaaaaggtgtccactgtgaagtaatattggtggagtcggggggagacttggtacagcctggcaggtccctgagactctcctgtgaagcctctggactcactttcgaggattatgccatgcactgggtccggcaagctccaggaaagggcctggagtgggtcgcaggtcttagctcgaatagtgatgacatagcctatgcggactctgtgaagggccgagttctccatttccagagacaacgccaggacggtccctgtttctgcagatgaatagactgagagatggagacacggccttatattattgtgttaaagnttagtctcgtctacactattttactactnta

SEQ ID NO: 531426 - DNA, 500 bp, Homo sapiens
  misc_feature: HEFZJCU01AXT2Q.51.34.D01.1.454.heavy.3.raw
  modified_base (299)..(299): a, c, t, g, unknown or other
cgatcgtatacacgaccggtgctcgatttagatcgtctgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctggggggaggcgtggtccagcctgggaggtccctgagactcgcctgtaaaccgtccggattcaccttcagtaactatgcaatgcactgggtccnccaggctccaggcaaggggctggactgggtggcaggcatatcatttgatggaagcaagaagtactatgcagactccgtgaaggggccgattcaccatctccagagacagttccgatgacacagtctatcctacacatgagcagtgtgtagacctgacgacacggcttactttttactgtcgcgccaggaagcagtggctgg

SEQ ID NO: 531427 - DNA, 311 bp, Homo sapiens
  misc_feature: HEFZJCU01A6FS5.22.28.C06.1.454.heavy.3.raw
acatacgcgtcacgaccggtgctcgatttagagctcacgtattgggtttggggaagtagtccaagaaccagacttccctgagactgacctctgtgaccgccgcagacacggccgtgtatttctgtgtcggtacgagtgtccatgacagtcacaaacaactggtctcctggggccagggaaccctggtcaccgtctcctcagcctccaccaagggcccatcggtcttccccctggcaccctcctccaagagcacctctggggggcacagcggccctgggctgcctggtcaaggactacttccagacgtatca

SEQ ID NO: 531428 - DNA, 512 bp, Homo sapiens
  misc_feature: HEFZJCU01A7AOG.9.64.F09.1.454.heavy.3.raw
tgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagagtcatatgtggactctgtgaagggccgattcatcatctccagagacaacgccgagaactccctgtatctgcaatgaacagctgagagtcgaaggacaacggctatgtattattgtgtgagagaataaaaggtgggccgagggaacccgtggtacaccgtctcc

SEQ ID NO: 531429 - DNA, 518 bp, Homo sapiens
  misc_feature: HEFZJCU01E0C47.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctcccgagagcacagcggccct

SEQ ID NO: 531430 - DNA, 518 bp, Homo sapiens
  misc_feature: HEFZJCU01B9JTE.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattaacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccaggggaaccctggtcaccgtctcctcagcctccaccaaggcccatcggtccttcccctggccaccctcctcc

SEQ ID NO: 531431 - DNA, 507 bp, Homo sapiens
  misc_feature: HEFZJCU01DZ440.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaatgaacagtctgagagcgaggacacggctctctattactagtgcgagagaccccgaaaatac

SEQ ID NO: 531432 - DNA, 501 bp, Homo sapiens
  misc_feature: HEFZJCU01CFQ2H.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaaggtgaggagcctgagatatagacgacacggccgtgtattattgtgcgagacgtggagtggcgagtggatagtcgaacgaattactacttac

SEQ ID NO: 531433 - DNA, 390 bp, Homo sapiens; identical to SEQ ID NO: 517848
  misc_feature: HEFZJCU01BZ1W9.16.24.C02.1.454.heavy.3.raw

SEQ ID NO: 531434 - DNA, 426 bp, Homo sapiens
  misc_feature: HEFZJCU01AOMFO.4.37.D04.1.454.heavy.3.raw
agcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaagtatgcacagaagtttcagggcagggtcaccatgaccagggacacgtccatcagcacgtccatcagcacagcctacatcgga

SEQ ID NO: 531435 - DNA, 476 bp, Homo sapiens
  misc_feature: HEFZJCU01EFH7M.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagccctacatcgggacctgagcgggcctgacatctgacgacacggccgtatatttctgt

SEQ ID NO: 531436 - DNA, 509 bp, Homo sapiens
  misc_feature: HEFZJCU01C0KH6.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgaccgtgggacgcgtccatcagcacagtctacatggatctgagcggactgacctctgacgacacggccatgtattacgtgtggaagagacgttgggtggctaccggcggggctcggaccacgtggggacccg

SEQ ID NO: 531437 - DNA, 494 bp, Homo sapiens
  misc_feature: HEFZJCU01CZFPH.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggggagaatcaacccgagtggaggtggtgcagagtacgcccagaggtttcagggcaggagtctccatgaccagtgacacgtccgcgagcactgtctatatggagatgagggagcctgagacttgacgacacggccgtatattactgttgcgagaatcgaaagaggtggctacaatccac

SEQ ID NO: 531438 - DNA, 532 bp, Homo sapiens
  misc_feature: HEFZJCU01BGSBQ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattgactacgtggggccgagggaaccctggtccaccgtctcctcagcctccaccaa

SEQ ID NO: 531439 - DNA, 530 bp, Homo sapiens
  misc_feature: HEFZJCU01C67XD.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaccagttctgcacaaaagttccagggcagactcaccctgactacagacgcatcaacgggctcagccttcatgaccctgaggaacctgagacctgacgacgcggccatctattactgtgcgagagagtgggtggcagcctcgtctcaggaactttggactttcgtcgggggccccggtaaccctggactccgtacccg

SEQ ID NO: 531440 - DNA, 474 bp, Homo sapiens
  misc_feature: HEFZJCU01CSWXV.51.37.D04.1.454.heavy.3.raw
  modified_base (443)..(443): a, c, t, g, unknown or other
cgatcgtatacacgaccggtgctcgatttagtagcatactgttgggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtactctgcaaatgaacnggctgagagctgaagacacggctgtatatta

SEQ ID NO: 531441 - DNA, 509 bp, Homo sapiens
  misc_feature: HEFZJCU01BJS93.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatgaccacgaactcctccataaacacagcctacatggagttagaggagcctgacatctgacgacacggccgtctattactgtgcgagagtccacgatccggtgagcctacggcagcggcctttgacttctggggccaggggtacg

SEQ ID NO: 531442 - DNA, 508 bp, Homo sapiens
  misc_feature: HEFZJCU01BX4D6.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccaggtgggaccgccatctacaacccgtcccgtcaagagtcgagtcagcatgtcagtcgacacgtcccagaaccagttctccctgacagtgagttatatgaccgccgcagacacggccgtgtattactgtgcgagagaggctgttatttaggacctagctcgttaaaaactcctactacggtctcggacgtctgt

SEQ ID NO: 531443 - DNA, 504 bp, Homo sapiens
  misc_feature: HEFZJCU01AF3ZV.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaatacaacagcctgagagtcgtaggacacggctgtatatttattgtgcgaggacgccccctacggtgtacgg

SEQ ID NO: 531444 - DNA, 525 bp, Homo sapiens
  misc_feature: HEFZJCU01DL0NF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctcaccaagggcccatcggtcttcccctggcgcctcg

SEQ ID NO: 531445 - DNA, 508 bp, Homo sapiens
  misc_feature: HEFZJCU01A2OD4.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcgacgattaccgacggacacccccacgaacacagtctacatgcaactgacgagcctgagagctgacgacacgggccgtctagtttactgtgcgaggaatgttttctgtcatcgtacaatttgataggctctatggactggacttcgtc

SEQ ID NO: 531446 - DNA, 511 bp, Homo sapiens
  misc_feature: HEFZJCU01AFFQA.17.25.C03.1.454.heavy.3.raw
  modified_base (456)..(456): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtcgngagagtcccacgactccgggtgacgcctacggcaggcggccttttgactttcctc

SEQ ID NO: 531447 - DNA, 514 bp, Homo sapiens
  misc_feature: HEFZJCU01D8WQQ.26.5.A05.1.454.heavy.3.raw
  modified_base (423)..(423): a, c, t, g, unknown or other
  modified_base (468)..(468): a, c, t, g, unknown or other
agactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttctggttacaactttcgtgaccatggtatcagctgggtgcgacaggcccctggacaagggcttgagtgggtgggatggatcagcccttacagtggtgacacagactatcatccagagaagttccagggccgggtcaccatgtccatggacacgttcacgaacacagtctacatggagctgacgagtctgacgtntgacgacacggccgtgtattactgtgcgagagaccctattcgttnttttagactacgtgggggccaggggaaccctggtccgaccgtctcg

SEQ ID NO: 531448 - DNA, 501 bp, Homo sapiens; identical to SEQ ID NO: 465219
  misc_feature: HEFZJCU01D0CS3.3.20.B09.1.454.heavy.3.raw

SEQ ID NO: 531449 - DNA, 540 bp, Homo sapiens
  misc_feature: HEFZJCU01B2KKK.18.33.C11.1.454.heavy.3.raw
tacgagtatgcacgaccggtgctcgatttagagtgagctcgttggttttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatcgagctgggtccgccaggctccagggaagggcctggagtggatctcacttatttatagtggtggtaccacatactacacagactccgtgaagggccgattcaccatctcagaagacaattccaggaacacattgtatcttacaaatgaataacctgagagccgaggacacggccatgtattactgtgtgggggcatttacttgtaccccgtggggcccggggaacccgtggtcaccgtcctccccacccctccaacccg

SEQ ID NO: 531450 - DNA, 489 bp, Homo sapiens
  misc_feature: HEFZJCU01ASNPG.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtgtgccacagactatgcaggctccgtgaggggccgattcacatctccagagacacgccaagaacacgctgtatctgcaaatgcacagtctgagacgccgacgatgcggctgtattatttctgtgacgaagagatacaacgtc

SEQ ID NO: 531451 - DNA, 537 bp, Homo sapiens
  misc_feature: HEFZJCU01DEHWG.14.26.C04.1.454.heavy.3.raw
cgtctagtaccacgaccggtgctcgatttagtctagcgactttgggtttgggggtctcagagaggagccttagccctggactccaaggcctttccacttggtgatcagcactgagcacagaggactcaccatggagttggggctgagctgggttttccttgttgctattttagaaggtgtccagtgtgaggtgcagttggtggactctgggggaggcttggtccagcctggggggtccctgagactctcctgtgcagcctctggattcacctttagtaaatattggatgatgtgggtccgccaggctccagggaagggctggagtgggtggcccacataaacgaagacggaattaagaaatactatctggactctgtgaagggccgattcaccatctccagagacaacgccgagaactcactgtatctgcagatgaacagcctgagagcgaagacacggccgtgtattactgtacgagagacgttggggtttaaaacttttgactagttcggggccagggaaccctggtcaccgtct

SEQ ID NO: 531452 - DNA, 532 bp, Homo sapiens
  misc_feature: HEFZJCU01AWRVG.11.27.C05.1.454.heavy.3.raw
  modified_base (401)..(401): a, c, t, g, unknown or other
  modified_base (498)..(498): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactccaccatctaaaaccngagacaacgccaagaactcactgtatctgcaaatgaacagcctgagagccggaggacgacggccgtagtatttatacgtgtacgaacgagtcggganattaattagtcgtccggaaccccgacgtcgggta

SEQ ID NO: 531453 - DNA, 508 bp, Homo sapiens
  misc_feature: HEFZJCU01BKTDT.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaagcgaggctgctggtgggacaacagactacgctgcacccgtgaagggcagattcacatctccagagatgattcaaggagcacagtgtttctacaaatgaacagcctgactggccggggacacgtgccgtgtattactgtgccagcagcagcacctcggccactatattttctttcg

SEQ ID NO: 531454 - DNA, 508 bp, Homo sapiens
  misc_feature: HEFZJCU01EGYGE.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgtactactggggccagggaactctaggtcaccgtctccgcagcctccacc

SEQ ID NO: 531455 - DNA, 478 bp, Homo sapiens
  misc_feature: HEFZJCU01A1424.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccactcggtcttccccctggccaccctcctccaagagcacctctgggggcacagcggccctgggctgcctggtcaaggactacttccgagtgtaca

SEQ ID NO: 531456 - DNA, 493 bp, Homo sapiens
  misc_feature: HEFZJCU01BPMNV.49.4.A04.1.454.heavy.3.raw
  modified_base (434)..(434): a, c, t, g, unknown or other
agtcgagagacacgaccggtgctcgatttagagtagtgatcagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcacctttcagggtctatgacatgcactgggtccgccaggctccaggcaaggggctggagtggggtggcatttatctcatatgatggaagcaagatatactacattgactccgtgaagggccgattcatcatctccagagacaactccgagaacacactgtatctcaatgaacnggttgagagtctgaagacgacggctttatatttactgtgcgaacttaatcacgggaacg

SEQ ID NO: 531457 - DNA, 503 bp, Homo sapiens
  misc_feature: HEFZJCU01DU4NA.11.71.G05.1.454.heavy.3.raw
  modified_base (361)..(361): a, c, t, g, unknown or other
  modified_base (492)..(492): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggttccgccagactccaggcagggggctggagtgggtggcagttatttcatatgatggaaatagtgacttntattcagactccgtgaagggccgattcaccgtctccagagacaattccaggcacacgctgtatctgcaaatgaacagcctgagagctgaggacacggctgtgtattactgtgacgaaagatttactatagnggtagacgtac

SEQ ID NO: 531458 - DNA, 508 bp, Homo sapiens
  misc_feature: HEFZJCU01DRCF2.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgtcaatactatacagactccgtgaagggccgattcaccatctccagagacaattccaagaacacgatgtatctgcaaatggacagcctaagagttgaggacacggctgtttattactgtacgaaaggaggggggatacgagtggcagctccaagtacttac

SEQ ID NO: 531459 - DNA, 520 bp, Homo sapiens
  misc_feature: HEFZJCU01EC480.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggcccatatattactgtgcgagagattggggccgacgggaaaccttgaactactggggccaggggaacccctggtaccaccgtt

SEQ ID NO: 531460 - DNA, 491 bp, Homo sapiens
  misc_feature: HEFZJCU01BLRSC.48.34.D01.1.454.heavy.3.raw
  modified_base (467)..(467): a, c, t, g, unknown or other
agtatacatacacgaccggtgctcgatttagatcgtctgtgttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggttggataaagccacgagcacagtctacatgcagctgagcagcctgagacacaacgacacggccgtctattattgttccctagganataatcgcgtagaataaagatata

SEQ ID NO: 531461 - DNA, 540 bp, Homo sapiens
  misc_feature: HEFZJCU01CVWQP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctaactggccaatactatgggggcttgttcgttggggccgaggggaccctggtcatcgttctccccacgcctccaccaagggccccaatcgggtccttccccctcggcgtccctcg

SEQ ID NO: 531462 - DNA, 523 bp, Homo sapiens
  misc_feature: HEFZJCU01EKWQE.4.28.C06.1.454.heavy.3.raw
agcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtggaggggccgattcaccatcttcagagacaacgccaaggacacgctgtatctggaaatgagcagtctgagagccgaggacacggctgtgtattactgtgcaagagataacggacttggtacgtccctttgacttacgtggggggccccgggaccgtc

SEQ ID NO: 531463 - DNA, 495 bp, Homo sapiens
  misc_feature: HEFZJCU01CM6WZ.51.1.A01.1.454.heavy.3.raw
cgatcgtatacacgaccggtgctcgatttagacgtctcatcagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacaacggtcccg

SEQ ID NO: 531464 - DNA, 525 bp, Homo sapiens
  misc_feature: HEFZJCU01CW1YZ.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaactccaggaacacaatgtatttggacctgaacagcctaagtcctgaggacacgggtagtatactactgtaacgaaggaggggggaaccgaggcgggagttccgaagtactcctttgtacg

SEQ ID NO: 531465 - DNA, 526 bp, Homo sapiens
  misc_feature: HEFZJCU01D6Y20.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccgaggctccagggaagggctggagtgcgtctcttttatttatagtagtggtagtacatactccgcagacctccgtggaggggccgattccaccatctccagagacaattccaagaacacgctgtttcttcaaatgaacagcctgagagccgatgacacggccgtgtattactgtgcgagagagtggggcccacgaacgttactacgctatggacgtcgtcggggccaagggacccg

SEQ ID NO: 531466 - DNA, 508 bp, Homo sapiens
  misc_feature: HEFZJCU01CF4IW.10.38.D05.1.454.heavy.3.raw
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 531467 - DNA, 514 bp, Homo sapiens
  misc_feature: HEFZJCU01BTBAB.40.59.F04.1.454.heavy.3.raw
tctagcgactcacgaccggtgctcgatttagtacacacacttagggattggggagctctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaggtctggagtgggtctcagtcatgggtacagctggtcacacatacctatgcagactccgtaaagggccgagttcaccatctccagagaagacgccaagaattccttgtatcttcagatgaacagtctgagaaccgagtgacacggctgtggtattattgttgacgtaaaaggggggagcgacggctaccggtccta

SEQ ID NO: 531468 - DNA, 517 bp, Homo sapiens
  misc_feature: HEFZJCU01EC75V.2.16.B05.1.454.heavy.3.raw
  modified_base (345)..(345): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggngatggaagtcaaaagaactatgtggactctgtgaagggccgattcaccatctccagagacaacgccaaagaactcactgtatctgcaaatgaaacagcctaagacccgaggacacggctgtgtattactgtgcgagagaccgctactgggggcccgggagcccgtggtaccg

SEQ ID NO: 531469 - DNA, 511 bp, Homo sapiens
  misc_feature: HEFZJCU01DGP1Y.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtggggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacaccggccactgtatttttgtgcgagccgaccggggctccgtcaatggctttcattactc

SEQ ID NO: 531470 - DNA, 427 bp, Homo sapiens; identical to SEQ ID NO: 452886
  misc_feature: HEFZJCU01DCIDR.4.37.D04.1.454.heavy.3.raw

SEQ ID NO: 531471 - DNA, 501 bp, Homo sapiens
  misc_feature: HEFZJCU01CZF61.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggccccctggacaaggtcttgagtggatgtcatggatcagcactttcaatggagacacaaagtatggagagaacttccagggcagagtcaccatgaccactgacagatcaacgaacatagcctacttggaactgagggcctgaggtctgacgacacggccctctattattgtgcgagaattaatttcgttattgttctggtggtgtgtgttcaatgtttgacc

SEQ ID NO: 531472 - DNA, 497 bp, Homo sapiens; identical to SEQ ID NO: 484462
  misc_feature: HEFZJCU01BN476.48.23.C01.1.454.heavy.3.raw

SEQ ID NO: 531473 - DNA, 554 bp, Homo sapiens
  misc_feature: HEFZJCU01DI6W5.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttctttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaaacactgtatctgctaattaaccagcctcgagagtcgaggacaacggccttttaattactgtagcgaaggatccgcccaataatggtaggttggatcgggggatttcggttccgtggggccaggggaacctggttcaccg

SEQ ID NO: 531474 - DNA, 517 bp, Homo sapiens
  misc_feature: HEFZJCU01BSHIP.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacgagcggtcccg

SEQ ID NO: 531475 - DNA, 323 bp, Homo sapiens
  misc_feature: HEFZJCU01DPOTS.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctacttcccatactcgta

SEQ ID NO: 531476 - DNA, 532 bp, Homo sapiens
  misc_feature: HEFZJCU01BY9J1.12.40.D07.1.454.heavy.3.raw
  modified_base (407)..(407): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacaacggctgtctattattgcncgagagagacacacgaacctactggccaatactatgggggcttgttctggggccaggggaccctggtcatcgtctccccagccctccaccaagggcccatcggtcttccccctggtccgccctcg

SEQ ID NO: 531477 - DNA, 510 bp, Homo sapiens
  misc_feature: HEFZJCU01EHIKC.10.38.D05.1.454.heavy.3.raw
catagtagtgcacgaccggtgctcgatttagtatctgatagtttggggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccaacctattattgtgcgcgacatgactacgctcaattctgggccagggagcccaggtcaccgtctccccagcctccaccaagggcccatcggtcttccccctggcgccctcgctccacggagcacctccgagagcacagcggccctgggctgcctggtcaaggactaccttcccactact

SEQ ID NO: 531478 - DNA, 514 bp, Homo sapiens
  misc_feature: HEFZJCU01D5BUK.49.81.H04.1.454.heavy.3.raw
agtcgagagacacgaccggtgctcgatttagtagtgtagattcgcggggtctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgtaacttaatcacggaggacaagggtcgacccccgtcacctc

SEQ ID NO: 531479 - DNA, 542 bp, Homo sapiens
  misc_feature: HEFZJCU01EGNH9.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctggggcccgggaacccgtcggtcaccgtctcctcagcctccaccaagggcccatcggtccttcccctcggccaccctccctccaagacg

SEQ ID NO: 531480 - DNA, 503 bp, Homo sapiens
  misc_feature: HEFZJCU01CIQLW.53.81.H04.1.454.heavy.3.raw
cgcgtatacacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaaggggactgggagtggggtggcagttatatcatttgatggaagcactacatactacgcaaactccgtgaagggccgattcaccatctccagagacgattccaggaacactctgttctccaaatgaacagcctgagagctgaggacacggctctttattactgtgcgagagtattctggatacagcctattta

SEQ ID NO: 531481 - DNA, 527 bp, Homo sapiens
  misc_feature: HEFZJCU01CQOBA.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatcccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtatactagtgcgagagagtggggcccacgaaccgttactacgctatggacgtctgggccgacgggacacc

SEQ ID NO: 531482 - DNA, 402 bp, Homo sapiens; identical to SEQ ID NO: 444815
  misc_feature: HEFZJCU01DGXUL.11.70.G04.1.454.heavy.3.raw

SEQ ID NO: 531483 - DNA, 514 bp, Homo sapiens
  misc_feature: HEFZJCU01B1CV1.40.65.F10.1.454.heavy.3.raw
  modified_base (443)..(443): a, c, t, g, unknown or other
  modified_base (491)..(491): a, c, t, g, unknown or other
tctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtagtttaccacagtgggagcacctactacaacccgtccctcaaaaagtcgaggcaccatatccgtagacacgtccaagaaccaattctcctgaagctgagctctgtgaccgccgcagacacggctgtctattactgtgcgaggccccgagcgcagtggtcttttagntgcctttgatatgtgggccgaaggacaactggtcaccgtctcttcgancctccaccgacggccagttccgg

SEQ ID NO: 531484 - DNA, 534 bp, Homo sapiens
  misc_feature: HEFZJCU01EUQDX.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcatcaccgacactgggaaccccacctatgcccaggccttcacagggcggtttgtcttctccatggatacctctcgtcgggacggcttatctgcagataaccaaccttcaacctgacgacactgccgtttattttgtacgagagcgtcgtctgtcagtggaattgacgtactggggccacgggaaccctggtcaccgtctcctcacgcctccaccgaac

SEQ ID NO: 531485 - DNA, 495 bp, Homo sapiens
  misc_feature: HEFZJCU01C6Y9E.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctaccaaaaagcaagtggtccttacaatgaccaacatggaccctttggacacagccacatattactgtgcacaccacagggtctctactgctggctttcagtaccaatggttcacccgtggggccagggaaccctggtcagcgtctcctca

SEQ ID NO: 531486 - DNA, 518 bp, Homo sapiens
  misc_feature: HEFZJCU01DD9VA.49.76.G10.1.454.heavy.3.raw
agtcgagagacacgaccggtgctcgatttagtcactcatacagggggcatcatccaacaaccacatcccttctctacagaagcctctgagaggaaagttcttcaccatggactggacctggagggtcttctgcttgctggctgtagctccaggtgctcacttccaggtgcagctggtgcagtctggggctgaggtgaagaagcctggggcctcagtgaaggtttcctgcaaggcatctggatacaccttgaccaactactatatacaatgggtgcgacaggcccctggacaaggacttgagtggatgggaataatcaaccctagcggtggaagtacaaccatcgcacagaaattccagggcagactcatcatgaccagggacacggtcccacgagccaccgtctaccatggaactgaaacagcctgagatctgaggacactgccgtgtattactgttgcgagggagttaccgttttatcggtgggacgttcggacccctaaaagtcctaccgtttacg

SEQ ID NO: 531487 - DNA, 519 bp, Homo sapiens
  misc_feature: HEFZJCU01C1PFY.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccagagcacctctgggggcacagcggccctgggctcgcctggtcaaggactacttcctagagacacg

SEQ ID NO: 531488 - DNA, 535 bp, Homo sapiens
  misc_feature: HEFZJCU01DLR4Y.4.59.F04.1.454.heavy.3.raw
  modified_base (430)..(430): a, c, t, g, unknown or other
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtntttctgtgcgagatctttcgtattttggtagtggtaaccccttggcttactggggccagggaaccctggtcaccgtctcttcagcctccaccaacgggccctacg

SEQ ID NO: 531489 - DNA, 519 bp, Homo sapiens
  misc_feature: HEFZJCU01BR5RB.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagactaaccgttccgcctggttattacc

SEQ ID NO: 531490 - DNA, 533 bp, Homo sapiens
  misc_feature: HEFZJCU01CKU0T.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgttcgtctgtcagtggaattgactactggggccagggaaccctggtcaccgtctcctcagcctccaccacggg

SEQ ID NO: 531491 - DNA, 496 bp, Homo sapiens
  misc_feature: HEFZJCU01BPTMO.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacgaggctcaccatcaccaaggacgcctccaaaaccaggtggtccttacaatgaccaacatggaccctgtggacacagccacatattactgtgcacagagatacgggcagcacgtggtttggggctacgtgggccgagggacctggtcaccgtctcctcagcctccaaccg

SEQ ID NO: 531492 - DNA, 399 bp, Homo sapiens; identical to SEQ ID NO: 495378
  misc_feature: HEFZJCU01B10K3.47.24.C02.1.454.heavy.3.raw

SEQ ID NO: 531493 - DNA, 391 bp, Homo sapiens; identical to SEQ ID NO: 445561
  misc_feature: HEFZJCU01A4BO6.13.77.G11.1.454.heavy.3.raw

SEQ ID NO: 531494 - DNA, 513 bp, Homo sapiens
  misc_feature: HEFZJCU01A4144.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcaggttattgaaacagatggcactacatattattctgactccgtgaagggccggttcaccctctccagagacacttccaacaacatcttgtatcttcacatgcacaatctgagagtcgacgacacgggccacctattattggtgcgcggacatgactacgcgtcaattcgtggggccaggggacg

SEQ ID NO: 531495 - DNA, 521 bp, Homo sapiens
  misc_feature: HEFZJCU01ARSNU.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattaactgtgcgagacatgacttccggtgacccctgggggccagggaaccctggtcaccgtctcctca

SEQ ID NO: 531496 - DNA, 505 bp, Homo sapiens
  misc_feature: HEFZJCU01CA1OY.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgctacgctcaattctggggccaggggacg

SEQ ID NO: 531497 - DNA, 507 bp, Homo sapiens
  misc_feature: HEFZJCU01BZRW3.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgaccagtgagttatatgaccgccgccagacacggccgtgtattactgtgcgagagaggccgttattttaggaccagctagttaaaactcctactacggtctgacgtctgtgcc

SEQ ID NO: 531498 - DNA, 512 bp, Homo sapiens
  misc_feature: HEFZJCU01AOQFJ.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacggttttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttctggggccaggggacg

SEQ ID NO: 531499 - DNA, 482 bp, Homo sapiens
  misc_feature: HEFZJCU01D1G7T.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactggtcaggcagtccccatcgagaggtctagagtggctgggaaggacatatttcatgtccaacacgtggaatacaaattatgcaccatctgttgagagtcgactgacaatcaacgtagacacatcgaagaaccagttctcctgcagctgacctctgtgactcccgaggacgacgggtgtatattaactgtggaagaggcccccgataga

SEQ ID NO: 531500 - DNA, 563 bp, Homo sapiens
  misc_feature: HEFZJCU01BMP2P.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttaataaattatgcggactccgtgaggggccgattcagcatctccagagacaacggcaagagtatactgtaatcttggaaatgaaactaaatctgagagtacgacgatacggcgttgtcgtataccattgttgtttttccgattcggtcccgtttccgggttcccggccgggggtaccgttttccgtggggggtacccgaacggggggtaaaccccc

SEQ ID NO: 531501 - DNA, 505 bp, Homo sapiens
  misc_feature: HEFZJCU01CJQBL.10.35.D02.1.454.heavy.3.raw
catagtagtgcacgaccggtgctcgatttagcacacgatagttgggtttgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctgggccagggagcccttgtcaccgtctcctcagcctccaccaagggcccatcggtcttcccctggcgccctgctccaggagcgacctcccgagaggcacagcggccctgggctgcctggtcaacggactcttcccactactatg

SEQ ID NO: 531502 - DNA, 514 bp, Homo sapiens
  misc_feature: HEFZJCU01B1L0G.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagtcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtacgaagacgacggctgtcgtattactgtgtcgtctcgtgacgccgtccggccgaccgttggctttcc

SEQ ID NO: 531503 - DNA, 491 bp, Homo sapiens
  misc_feature: HEFZJCU01CR9Z5.40.81.H04.1.454.heavy.3.raw
  modified_base (481)..(481): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtcatcagcacagtctacatggatctgagcggactgacctctgacgacacggccactgtattactgtggaagagacgttggtggcttaccgnggggctgacc

SEQ ID NO: 531504 - DNA, 519 bp, Homo sapiens
  misc_feature: HEFZJCU01CTMPM.12.25.C03.1.454.heavy.3.raw
  modified_base (489)..(489): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatcggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggcgtcgtcctttgactacgnggggcctgggaactcgtggtcaccgtctcc

SEQ ID NO: 531505 - DNA, 547 bp, Homo sapiens
  misc_feature: HEFZJCU01DHNMI.52.49.E05.1.454.heavy.3.raw
  modified_base (427)..(427): a, c, t, g, unknown or other
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagntctgacgacacggccgtttattactgtgtgagagattttaggggacctcggcccgttgggggagttagtcgttactttgacttacgtggggccagggaacccaggtaccaccgtctcccg

SEQ ID NO: 531506 - DNA, 506 bp, Homo sapiens
  misc_feature: HEFZJCU01DZUO2.17.33.C11.1.454.heavy.3.raw
  modified_base (476)..(476): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggatgggctggatccgtcagcccccaggaaaggccctggagtggcttgcgctcatttattgggatgagagtaagcactacagtccgtctctgaagaacaggctcaccatcaccaagacacctccacaaaccaggtggtccttacaatgaccaatatggaccctgtggacacagccacatattactgttcacgctctatggttcggggagttattagtccctactttgactactgggcagggaactcngtcaccgtctcgcagcctccaccaaggccc

SEQ ID NO: 531507 - DNA, 497 bp, Homo sapiens
  misc_feature: HEFZJCU01DVTKU.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtattttaccacagtgggagcacctactacaacccgtccctcaaaagtcgaggcaccatatccgtagacacgtccaagaaccaattctccctgaagctgagctctgtgaccgccgcagacacggctgtcctattactgtgcgagccccgagcgcagtgcgttttgatgccgtttgatatgtggggaccgaaggggacg

SEQ ID NO: 531508 - DNA, 527 bp, Homo sapiens
  misc_feature: HEFZJCU01AOVF5.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacagggcttctacttctgtgcgaggagtaattactataacactgctccttttacacctcccttgacttctgggccgatggaacccggtccg

SEQ ID NO: 531509 - DNA, 494 bp, Homo sapiens
  misc_feature: HEFZJCU01CN6M6.48.69.G03.1.454.heavy.3.raw
agtatacatacacgaccggtgctcgatttagtcgctgcgtaaaggagaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggtcttttgatgcttgtatatgtgggcgaagggacat

SEQ ID NO: 531510 - DNA, 518 bp, Homo sapiens
  misc_feature: HEFZJCU01DZ642.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcccctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctgaagaccgaggacgacagcccgtctatttactgttggttagggtagttttacgtatttttggta

SEQ ID NO: 531511 - DNA, 503 bp, Homo sapiens
  misc_feature: HEFZJCU01DGVVX.17.25.C03.1.454.heavy.3.raw
  modified_base (460)..(460): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccaataaacacagcctacatggagttgaggagcctgacatctgacgacacggccgtctattactgtgcgagngtcccacgatccggtgagcctacggcagcggcctttgaccttc

SEQ ID NO: 531512 - DNA, 494 bp, Homo sapiens
  misc_feature: HEFZJCU01B67L7.11.26.C04.1.454.heavy.3.raw
  modified_base (204)..(204): a, c, t, g, unknown or other
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggccgccctgctccaggagcacctccgagagcacagcggccctgggctggcctggtcaaggactacttccgtatctctcg

SEQ ID NO: 531513 - DNA, 502 bp, Homo sapiens
  misc_feature: HEFZJCU01BHRGJ.8.37.D04.1.454.heavy.3.raw
ctcgcgtgtccacgaccggtgctcgatttagtagcatactgttgggtttggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagctttgaattttggggccaagggacaatggtcatcgtctcctcagcctccaccaagggcccatcggtcttcccctggcaccctcctccaagagcacctctgggggcacagcggccctgggctgcctggtcaaggactacttccgacacgcgag

SEQ ID NO: 531514 - DNA, 526 bp, Homo sapiens
  misc_feature: HEFZJCU01EIKML.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaagggaggggggaaccagcgggagttccgaagtactcctttgacgtcgtc

SEQ ID NO: 531515 - DNA, 499 bp, Homo sapiens
  misc_feature: HEFZJCU01DLU4D.49.57.F02.1.454.heavy.3.raw
  modified_base (421)..(421): a, c, t, g, unknown or other
agtcgagagacacgaccggtgctcgatttagctcgatatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcncagcctaggatctgccgacaccgggccgtatatttctgtgcgagagagatgtctttctattgatagtactagtcattt

SEQ ID NO: 531516 - DNA, 510 bp, Homo sapiens
  misc_feature: HEFZJCU01BA4YY.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctaccctgaagctgagctctgtgaccgccgcagacacggctgtcctattactgtgcgaggccccgagcgcagtggctttttgatgcctttgactattgtgggggtccaacggggacaagtggtcaccgtcgtt

SEQ ID NO: 531517 - DNA, 539 bp, Homo sapiens
  misc_feature: HEFZJCU01DS4GW.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaactatggggactctgtgaagggccgattcaccatctccagagacaaccgtaagaacttactgtttctgcaaatgaacagcctgagagccgaggacacggctgtgtattattgtgcgaagggcagtggcgtggggacatggacgtcgtgggggaccaaggggaccacgggtccaccggt

SEQ ID NO: 531518 - DNA, 528 bp, Homo sapiens
  misc_feature: HEFZJCU01B9EE5.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgtacttctggggccatggaaccccggt

SEQ ID NO: 531519 - DNA, 524 bp, Homo sapiens
  misc_feature: HEFZJCU01CB91N.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttggggaggggccgtttctat

SEQ ID NO: 531520 - DNA, 407 bp, Homo sapiens
  misc_feature: HEFZJCU01AO603.49.61.F06.1.454.heavy.3.raw
  modified_base (220)..(220): a, c, t, g, unknown or other
agtcgagagacacgaccggtgctcgatttagctacgctctaagggaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctnacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 531521 - DNA, 509 bp, Homo sapiens
  misc_feature: HEFZJCU01EQI5M.48.1.A01.1.454.heavy.3.raw
agtatacatacacgaccggtgctcgatttagacgtctcatcaagaaggaagggggagagaggagccttagccctggattccaaggcctatccacttggtgatcagcactgagcaccgaggattcaccatggaactggggctccgctgggttttccttgttgctattttagaaggtgtccagtgtgaagtacagctggtggagtctgggggaggcctggtcaagcctggggggtccctgagactctcctgtgcaacctctggattcacattcactagatataccatgaactgggtccgccaggctccagcgaaggggctggagtgggtctcctccataagtagtggcagttcttacttacattaccgcagactcagtgaagggccgattcgccatctccagagacaacgccaacaactcactgtttctgcagatggacaacctgagaggcgaggacacggctgtatattacttgtgtcctccccatacatcgcagctcgtggcacggtac

SEQ ID NO: 531522 - DNA, 520 bp, Homo sapiens
  misc_feature: HEFZJCU01BHT26.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattatgtgcgagagtaagtggtcatggtccttttgaccagtgggccagggaaccctggtcaccgtctcctcagcttccacctaagggcccatcggtcttcccctggccgccctcgcttccaggagacacctcgtggggcgacgagccggcccg

SEQ ID NO: 531523 - DNA, 506 bp, Homo sapiens
  misc_feature: HEFZJCU01A937S.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatcattacggtttggacgtctggggccaagggaccacggtcatcgtctccccacgcctccaccaacgggcccatcggtcttcccctggcgccctcgctcc

SEQ ID NO: 531524 - DNA, 479 bp, Homo sapiens
  misc_feature: HEFZJCU01CAWT1.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctgcaccgtctcctcagcctccaccaagggcccatcggtcttcccctggcaccctcctccaagagcacctctggggcacagcggccctgggctgcctggtcaaggactacttcctagagacacg

SEQ ID NO: 531525 - DNA, 443 bp, Homo sapiens; identical to SEQ ID NO: 446583
  misc_feature: HEFZJCU01BVSBO.10.11.A11.1.454.heavy.3.raw

SEQ ID NO: 531526 - DNA, 513 bp, Homo sapiens
  misc_feature: HEFZJCU01DUFQ5.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatagttactggtgcgaagctttagcggttaccggctacgattggggagcgactggttcgacccctggggccaggggaaccctggtcaccgtctcctcagcctccaccaagggcccatcggtcttcccctggcaccctcctccaagagcacctctgggggcacagcggcccgtgggctgcctggtcaaggactactcctacgtcgtat

SEQ ID NO: 531527 - DNA, 556 bp, Homo sapiens
  misc_feature: HEFZJCU01AT9SJ.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtggtggggctatttaactttcgacccccgttgggggcccgggggtaaccccgtcgggtccacccggttcctcccccacccccttcccaaccc

SEQ ID NO: 531528 - DNA, 503 bp, Homo sapiens
  misc_feature: HEFZJCU01D8EVD.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagttttgtttgggcgggatagcaggcgggacc

SEQ ID NO: 531529 - DNA, 509 bp, Homo sapiens
  misc_feature: HEFZJCU01E1OP9.51.81.H04.1.454.heavy.3.raw
cgatcgtatacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatagaacagcctgagagactgaggacacggctattgttttactgttgcgagaggggaactcgattacagcacgcctacg

SEQ ID NO: 531530 - DNA, 503 bp, Homo sapiens
  misc_feature: HEFZJCU01CGUTU.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaatgaacagcctgagggccgaggacacggccgtctattattgtgtgagagtttatggcgatggctggtggacagatcac

SEQ ID NO: 531531 - DNA, 519 bp, Homo sapiens
  misc_feature: HEFZJCU01CXFBC.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggtaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactagtgcgacagaagcggcggacagaggttacgctttactggttcggaggctcctcccccg

SEQ ID NO: 531532 - DNA, 533 bp, Homo sapiens
  misc_feature: HEFZJCU01DU540.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaagggctggaatggattcgacaggtcaatcattacagatccaccaactacaacccgtccctcagcagtcgagtcaccttttcgcttgacacgtccaacaaccagttttcctctcgaataccaaaacccgagaacccgccgccggacacgcctccggccccgtggggccccagaaaccccg

SEQ ID NO: 531533 - DNA, 531 bp, Homo sapiens; identical to SEQ ID NO: 455628
  misc_feature: HEFZJCU01DWTIM.13.10.A10.1.454.heavy.3.raw

SEQ ID NO: 531534 - DNA, 543 bp, Homo sapiens
  misc_feature: HEFZJCU01BJWKA.8.25.C03.1.454.heavy.3.raw
ctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactctgggggaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagccctgaaaaccgaggacacaggcgtgtattactgcaacaggtttggttcgggaaatccgcaaaatgacctctggggccagggaaccctggtccaccgtct

SEQ ID NO: 531535 - DNA, 537 bp, Homo sapiens
  misc_feature: HEFZJCU01AMURG.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattattgtgtgagatacgacttttggaatggctatgactcgatcgactactgggccctggaatcctggtcaccgtctcctcagcctccaccaacgggcccatcggtcttccccctcggccaccct

SEQ ID NO: 531536 - DNA, 513 bp, Homo sapiens; identical to SEQ ID NO: 446699
  misc_feature: HEFZJCU01BSZL2.12.25.C03.1.454.heavy.3.raw

SEQ ID NO: 531537 - DNA, 432 bp, Homo sapiens; identical to SEQ ID NO: 444920
  misc_feature: HEFZJCU01EPQ4F.11.39.D06.1.454.heavy.3.raw

SEQ ID NO: 531538 - DNA, 514 bp, Homo sapiens
  misc_feature: HEFZJCU01C9OP5.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaactttttacgattatggcatgacctgggtccgccaagctccagggaagggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctgggccaagggaccacggtcatcgtctcctcagcctccaccaagggcccatcggtcttcccctggcaccctcctccagagcacctctggggc

SEQ ID NO: 531539 - DNA, 374 bp, Homo sapiens
  misc_feature: HEFZJCU01C521X.49.69.G03.1.454.heavy.3.raw
agtcgagagacacgaccggtgctcgatttagtcgctgcgtaaaggagaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaaggcccatcgtcttccccctggcaccctcctccaagagcacctctgggggcacagcggccctgggctgcctggtcaaggactactcctctctcgact

SEQ ID NO: 531540 - DNA, 488 bp, Homo sapiens
  misc_feature: HEFZJCU01BFMF0.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggatctgtgaagggccgattcaccatctccagagacaacgccaagaactccctgtatctgcaaatgaacagtctagagagctgaggacacggccttgtaattacgtgtgcaaggaggtataggctacg

SEQ ID NO: 531541 - DNA, 500 bp, Homo sapiens
  misc_feature: HEFZJCU01DW316.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagactcactgtctctgcaatgaacagcctgagagtcgagacacggctgtgtattactgtgacgagagatccgggaaggggacgtaatgacc

SEQ ID NO: 531542 - DNA, 466 bp, Homo sapiens; identical to SEQ ID NO: 445835
  misc_feature: HEFZJCU01AEFC6.9.34.D01.1.454.heavy.3.raw

SEQ ID NO: 531543 - DNA, 509 bp, Homo sapiens
  misc_feature: HEFZJCU01DMUPF.51.27.C05.1.454.heavy.3.raw
cgatcgtatacacgaccggtgctcgatttagacgcgatcgaagggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggagtccctgagactcgcctgtacaccctctggattcaccttcagtaactatgcaatgcactgggtccgccaggctccaggcaaggggctggactgggtggcaggtatatcatatgatggaagcaataaagtactacgcagactccgtgaagggccgattcaccatctccagagacagttccgatgacacagtctatctgcaaatgaacagcctgagagcgtgaggtacgaacggtcttaccgttttttaactggttgccgaccgaacggaaagcctaaggt

SEQ ID NO: 531544 - DNA, 517 bp, Homo sapiens
  misc_feature: HEFZJCU01DL2QC.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactactcagacgtatca

SEQ ID NO: 531545 - DNA, 510 bp, Homo sapiens
  misc_feature: HEFZJCU01EGF32.4.81.H04.1.454.heavy.3.raw
agcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattggggtccgccaggctccagggaaggggctggagtgggtctcatccatcagttccagtactcgttacatatactacgcagactcagtgagggggccgattcaccatctccagagacaacgccaagaactcagtgtttctgcaaatgaacagcctgagagtcgaggactcggctgtctatactgtgcgaggaataagggagctacctacgtatttggacac

SEQ ID NO: 531546 - DNA, 492 bp, Homo sapiens
  misc_feature: HEFZJCU01EA9MY.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgagatgaagggcagagtcacgattaccacggacacccccacgaacacagtctacatgcaactgacgagcctgagagctgacgacacggccgtctagtactgtgcgagaatgttttctgtcatcgtacatttgataggctctatggactgg

SEQ ID NO: 531547 - DNA, 476 bp, Homo sapiens; identical to SEQ ID NO: 452095
  misc_feature: HEFZJCU01BI1FC.16.10.A10.1.454.heavy.3.raw

SEQ ID NO: 531548 - DNA, 512 bp, Homo sapiens
  misc_feature: HEFZJCU01A0RLD.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtcaccctatactactttgaactactggggcc

SEQ ID NO: 531549 - DNA, 514 bp, Homo sapiens
  misc_feature: HEFZJCU01BYMOG.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaagggctggagtgggtcgcatccattagtggtggtaataattacatatactacggagactcaatgaagggccgcttcaccatctccagagacaacgccgaaaactcactgtatctgcagatgaacagcctgagagccgaagacaacggctgtgtattactgtgcgagaggtcttactatagttcggggagttaatataacgacgtattcgta

SEQ ID NO: 531550 - DNA, 509 bp, Homo sapiens
  misc_feature: HEFZJCU01B10ES.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtccctgggggcccgggaacccggggtc

SEQ ID NO: 531551 - DNA, 391 bp, Homo sapiens
  misc_feature: HEFZJCU01DQ1LR.40.31.C09.1.454.heavy.3.raw
tctagcgactcacgaccggtgctcgatttagacgtctcatcaaggaaggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttcccctggcaccctcctccaagagcacctctgggggcacagcggccctgggctgcctggtcaaggactacttccagtcgctag

SEQ ID NO: 531552 - DNA, 505 bp, Homo sapiens
  misc_feature: HEFZJCU01DHIYB.17.10.A10.1.454.heavy.3.raw
  modified_base (426)..(426): a, c, t, g, unknown or other
  modified_base (460)..(460): a, c, t, g, unknown or other
  modified_base (470)..(470): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccacggacacccccacgaacacagtctacatgcaactgacgagcctgagagctgacganaccggccgtctattactgtgcgagaatgttttcngtcatcgtanaatttgataggctctatcggactggtaccttcgtc

SEQ ID NO: 531553 - DNA, 503 bp, Homo sapiens
  misc_feature: HEFZJCU01DW8YM.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccaggggaaggggctggagtgggtctcatccattagtagtaatagtgcctacagatactacgcagactcactgaagggccgactcaccatctccagagacaacgccaagaactacactgtatctgcaaatgaacagcctgagagccgaggacacggctgtgtattactgtgcgagaggagactattatctacggaacccca

SEQ ID NO: 531554 - DNA, 519 bp, Homo sapiens
  misc_feature: HEFZJCU01BFCI4.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttcccctggcaccctcctccaagagcacctctgggggcacgagcggccctgggctgcctggtcaacggctacttccagacgtatca

SEQ ID NO: 531555 - DNA, 529 bp, Homo sapiens
  misc_feature: HEFZJCU01BN9BX.5.64.F09.1.454.heavy.3.raw
atcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtccctgtctttggagcagcaaactacgcacatgatttccaggggagagtcacgattacggcggacgaatctacggccacagcctatctggagctgaacaacgtgagacctgaagacacggccgtttactactgcgcgagagatccgccccccgaaggggccgaacgaggtataggtgggggcgaacggctttgggccttctactactactac

SEQ ID NO: 531556 - DNA, 477 bp, Homo sapiens
  misc_feature: HEFZJCU01AWFVL.19.13.B02.1.454.heavy.3.raw
tactctcgtgcacgaccggtgctcgatttagtctagcgacttccgcagggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgcagcctctggattcaccttcagtagctatggcatgcactgggtccgcaggctccaggcaaggggctggagtgggtggcagttatatcatatgatggaagtaataaatactatgcagactccgtgaagggccgattcaccatctccagagacaattccaagaacacgctgtatctgcaatgaacagcctgagagctgaggacacggctgtgtattactgtgcga

SEQ ID NO: 531557 - DNA, 515 bp, Homo sapiens
  misc_feature: HEFZJCU01AZXGM.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaaggacacggcagtgtattactgtgcgagagatcgacatgactacgggaaaagcttttgatctctggggccaagggacactggtcaccgtctcttcagcctccaccagggcccagtccggttccttccccctggccgccctgcctccaggacg

SEQ ID NO: 531558 - DNA, 518 bp, Homo sapiens
  misc_feature: HEFZJCU01D5BCH.48.26.C04.1.454.heavy.3.raw
  modified_base (455)..(455): a, c, t, g, unknown or other
  modified_base (500)..(500): a, c, t, g, unknown or other
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtgggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgngagagaagggttttactagttggttcggggagtcgtccgacccgngacaactggttcgacccc

SEQ ID NO: 531559 - DNA, 482 bp, Homo sapiens
  misc_feature: HEFZJCU01BBXDW.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctacttcagcctccaccaagggcccatcggtcttcccctcggcgccctgctccaggagcacctccgagagcacagcggccctgggctgcctggtcaaggactacttccagacgtatca

SEQ ID NO: 531560 - DNA, 540 bp, Homo sapiens
  misc_feature: HEFZJCU01CLSXX.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtagttaaaaccaaaactgatggtgggacaacagactacgctgcacccgtgaaaggcagattcaccatctcaagagatgattcaaaagcacgctgtatctgcaatgaacagcctgagaccgaggacacagccgtgtattactgtaccacatcccctgaaagcgtcaactactactactacggtatggacctctggggccaagggaccg

SEQ ID NO: 531561 - DNA, 509 bp, Homo sapiens
  misc_feature: HEFZJCU01DMQ6Z.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtccacgatccggtgagcctacggcagcggcctttgtacttctggggtccagggacg

SEQ ID NO: 531562 - DNA, 518 bp, Homo sapiens
  misc_feature: HEFZJCU01DZ8WA.40.54.E10.1.454.heavy.3.raw
  modified_base (358)..(358): a, c, t, g, unknown or other
tctagcgactcacgaccggtgctcgatttagatcgtagcagaacacacaaagggggctctgggagaggagccccagccctgagattcccaggtgcttccattcagtgatcagcactgaacacagaggactcaccatggagttgggactgagctggattttccttttggctattttaaaaggtgtccagtgtgaagtgcagctggtggagtctgggggagcttggtacagcctggcaggtccctgagactctcctgtgcagcctctggattcatctttgatgcctatgccatgcactgggtccggcaagctccagggaaggcctggagtgggtctcagtattagttggaatgggggtancgtaggcgatgcggactttgtgaagggccgagttcacccatctccagagacaacgccaagaatcactctctctacacatgaccaggcccttgaccgtagcccggaaggaccgacggcttgttttactttacgttagtgtaccgaggagagttgggtaccg

SEQ ID NO: 531563 - DNA, 500 bp, Homo sapiens; identical to SEQ ID NO: 457512
  misc_feature: HEFZJCU01AU5DJ.19.26.C04.1.454.heavy.3.raw

SEQ ID NO: 531564 - DNA, 502 bp, Homo sapiens
  misc_feature: HEFZJCU01EWL3H.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtc

SEQ ID NO: 531565 - DNA, 495 bp, Homo sapiens
  misc_feature: HEFZJCU01BZLDQ.51.71.G05.1.454.heavy.3.raw
cgatcgtatacacgaccggtgctcgatttagtgtcgtcgcaagagagagggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacagttcttctacaaatgaacagcctgagagctgaggacacggctattgtttaactgtgcgagagggtactcggattacg

SEQ ID NO: 531566 - DNA, 536 bp, Homo sapiens
  misc_feature: HEFZJCU01DCE7P.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttagttggggccagggagcctggtcaccg

SEQ ID NO: 531567 - DNA, 523 bp, Homo sapiens
  misc_feature: HEFZJCU01ESL8Z.7.28.C06.1.454.heavy.3.raw
  modified_base (396)..(396): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgcccganaacctcactgtctctgctgatgagcagcctgagagccgacgacacggctatctattctgtgacgaaactctcacttccgttcattctagaatacgtgggggccaggggaacccctgggtccgtcccg

SEQ ID NO: 531568 - DNA, 525 bp, Homo sapiens
  misc_feature: HEFZJCU01DFEH0.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaattgaacagcctgagaaccgacgacacggccgtctattattgtgtcagtagacctaggaatacaacggtacggtggtaaccgtggtattc

SEQ ID NO: 531569 - DNA, 555 bp, Homo sapiens
  misc_feature: HEFZJCU01B06O1.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggcacgggaacccgtggtgaccgtctcctcacgcctccaccaacgggcccatccggtcttcccccgtggccgccctgcctccgacggtacgaccgacccttcccggacgacgccacgacgccggcccgttcggggccg

SEQ ID NO: 531570 - DNA, 373 bp, Homo sapiens
  misc_feature: HEFZJCU01BLWUT.51.6.A06.1.454.heavy.3.raw
cgatcgtatacacgaccggtgctcgatttagatctactgacaggggaaggaagcaataaatactacgcagactccgtgaagggccgattcaccatctccagagacaatcccaagaacacactttatctgcaaatgaacaccctgagacttgaggacacggctgtctattattgtgcgagagggagatcgatcacagcagccctcgaagaccagcatgatggttttgatgtctggggccaagggacaatggtcaccgtctcttcagcctccaccaagggcccatcggtcttccccctggcaccctcctccaagagcacctctgggggcacagcgccctgggctgcctggtcaaggactacttcctcgtagcact

SEQ ID NO: 531571 - DNA, 519 bp, Homo sapiens
  misc_feature: HEFZJCU01CP5G0.52.57.F02.1.454.heavy.3.raw
cgcagtacgacacgaccggtgctcgatttagctcgatatagttgggtttgggggaggcttggtccagcctggggggtccctgacactctcctgtgtagcctctggattcacctttaacagttattggatgacttggggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtggcaccctggtcactgtcttctcagcctccaccaagggcccatcggtcttcccctggcaccctcctccaacgagctacctcgtgggggcacagcggccctgggctgcctggtcaaggactactcctatacg

SEQ ID NO: 531572 - DNA, 508 bp, Homo sapiens
  misc_feature: HEFZJCU01D3GC0.53.34.D01.1.454.heavy.3.raw
cgcgtatacacacgaccggtgctcgatttagatcgtctgtgttgggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggcccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtgtttccatgatgtcttttgat

SEQ ID NO: 531573 - DNA, 500 bp, Homo sapiens
  misc_feature: HEFZJCU01BVM01.40.12.B01.1.454.heavy.3.raw
tctagcgactcacgaccggtgctcgatttagtagtgtagattccgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctcgtgacgacacggccatgtattactgtggagagcgttggtgctaccgcggggctgaccacgtgggaccg

SEQ ID NO: 531574 - DNA, 502 bp, Homo sapiens; identical to SEQ ID NO: 456269
  misc_feature: HEFZJCU01A3M1S.17.10.A10.1.454.heavy.3.raw

SEQ ID NO: 531575 - DNA, 518 bp, Homo sapiens
  misc_feature: HEFZJCU01EN2XW.16.39.D06.1.454.heavy.3.raw
tgtactactccacgaccggtgctcgatttagtgacatctcgcagttctttggggggagaggagcccagcactgggattccgaggtgtttccattcggtgatcagcactgaacacagaggactcaccatggagttttggttgagttgggttttccttgctgctattttaaaaggtgtccagtgtgaggtgtacttggtggagtctggaggaggcttgacccagccgggggggtccctgagactctcctgtgcagcctctggattcacccttagcggttatgccatgagctgggtccgccaggctccagggaagggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccct

SEQ ID NO: 531576 - DNA, 532 bp, Homo sapiens
  misc_feature: HEFZJCU01BZSDF.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgataccaatttgggaggggcctttcatgtctggggccaagggacgctggtcaccgtctcttcagcctccaccaaggcccatcggtcttccctggcaccctcctccaagacgcacctctcgggggcac

SEQ ID NO: 531577 - DNA, 430 bp, Homo sapiens; identical to SEQ ID NO: 471364
  misc_feature: HEFZJCU01BFMAC.4.37.D04.1.454.heavy.3.raw

SEQ ID NO: 531578 - DNA, 526 bp, Homo sapiens
  misc_feature: HEFZJCU01CFX9A.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctgggagtgggtggcacttatctcatctgatggaagagatgcctattacgcagactccgtgaagggccgattcaccatctccagagacaattcaagaacacactgtatctgcaaatggacagcctgagagctgaagacacggctgtgtattactgtgcgagtgagatgtcttactatgatgccagtggtttggtaccgttcgaccctcggggccagggaaccctgggtcaccgtctcctcacgtcttccaaccgaacggggccccagtccggtcctttccccctcggtccgtccccg

SEQ ID NO: 531579 - DNA, 481 bp, Homo sapiens
  misc_feature: HEFZJCU01CXR40.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggacgcacctccgagaggcacagcggccctgggctgcctggtcaaggactattccacgcgtatgt

SEQ ID NO: 531580 - DNA, 381 bp, Homo sapiens
  misc_feature: HEFZJCU01AW2GW.40.81.H04.1.454.heavy.3.raw
tctagcgactcacgaccggtgctcgatttagtagtgtagattcgcggggacacatctgtcctctagagaatcccctgagagctccgttcctcaccatggactggacctggaggatcctcttcttggtggcagcagccgcaggagcccactcccaggtgcagctggtacagtctggggctgaggtgaagaagcctggggcctcggtgaaggtctcctgcaagatttctggaaacaccctgagcaaacttactacatacactggatgcggcaggcccctggactaggggtttgagtggatggggtggatcaaccctaccagaggtggcacaaagtatcgacagaactttcagggcagggtcaccatgacctgggaccgcgtcc

SEQ ID NO: 531581 - DNA, 518 bp, Homo sapiens; identical to SEQ ID NO: 461541
  misc_feature: HEFZJCU01C8DCD.13.76.G10.1.454.heavy.3.raw

SEQ ID NO: 531582 - DNA, 511 bp, Homo sapiens
  misc_feature: HEFZJCU01D33AA.12.78.H01.1.454.heavy.3.raw
atacgacgtacacgaccggtgctcgatttagtgtgagtagtttgggtttgggggaggcttggtacagcctggggtgtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgccgtggtcgaaggactacttcctacgtcgtat

SEQ ID NO: 531583 - DNA, 510 bp, Homo sapiens
  misc_feature: HEFZJCU01DQ45Q.17.34.D01.1.454.heavy.3.raw
cgtagactagcacgaccggtgctcgatttagatcgtctgtgttggggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacagggcttctacttctgtgcgagagtaattactatacactgctccttttacacctccttgcttctgggcc

SEQ ID NO: 531584 - DNA, 508 bp, Homo sapiens
  misc_feature: HEFZJCU01BEQOQ.2.33.C11.1.454.heavy.3.raw
acgctcgacacacgaccggtgctcgatttagagtgagctcgtgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtactattaggactactatagtccctgggggtcccaggggtaa

SEQ ID NO: 531585 - DNA, 515 bp, Homo sapiens
  misc_feature: HEFZJCU01CWILV.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgaccctgggtccgccaggctccagggaaggggctggagtggggtggccaacataaacaagacggaagtcagaaaaactatgtggactctgtgaacggccgattcaccatctccagagacacgccaagaattcactgtattgcaaatgaaacagcctgagaggcgaggacacggcgtagtattattgtgacgcgacgatgatagtagactctacagtagcagggtggta

SEQ ID NO: 531586 - DNA, 525 bp, Homo sapiens
  misc_feature: HEFZJCU01B69WU.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacattttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttataccttgacacttgggccagggaaccctggtcaccgtctcctcagcctccaccaagggcccatcggtcttcccctggcgccctgctccaggagcacctccgagagcacagcggccctgggctgcctggtcaaggactactccacg

SEQ ID NO: 531587 - DNA, 517 bp, Homo sapiens
  misc_feature: HEFZJCU01CWS4O.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccaggacaacgccaagaactcactgactttgcaaatgaacaccctgcgagccgaggacacggccggtatattactgtgcgagaataacccgttcgcctggtattaccttgacacttggggccagggaaccctggtcaccgtctcctcagcctccaccaaggcccatcgtcttcccctggcgccctgctccagagcacctccgacgagcgacagcggccctcgggcgtgcctcggtcgaaggacctaccttccacgaacgtaatcta

SEQ ID NO: 531588 - DNA, 535 bp, Homo sapiens
  misc_feature: HEFZJCU01E2HDZ.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacattgcctgggtgcgacaggcccctggacatgggcttgagtgggtgggcaggatcatccctatgtttggagtcgcaactacgcacagaagttccggggcaaagtcacgttgaccgcggacacagtcacggacacagcctacatggaactcaacggcctcagatttgaggacacggccgtctattattgtgcgagagtgagaaattacggtggtctaccttcccttgtacctactcggggtccgacggggaacccgtcggtcctaccc

SEQ ID NO: 531589 - DNA, 489 bp, Homo sapiens
  misc_feature: HEFZJCU01ERT2V.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatggggtggcagatatacaatatgatgacagtaaaatatactatggagactccttcaagggccgattcaccatctccagagacaattccaagaacatgtgtatctgcaatgacagcctgagagccggagacacgggtgtttattactggtgggagaaatccta

SEQ ID NO: 531590 - DNA, 534 bp, Homo sapiens
  misc_feature: HEFZJCU01BR4KV.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattgggtctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgtccaggctccaggggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagtattagcgcactactttgactactggggccaggggaaccctgggtcaccgt

SEQ ID NO: 531591 - DNA, 506 bp, Homo sapiens
  misc_feature: HEFZJCU01DRCEK.10.55.E11.1.454.heavy.3.raw
  modified_base (423)..(423): a, c, t, g, unknown or other
catagtagtgcacgaccggtgctcgatttagcactcgcacgttgggtttgggctcaactctcttgtccaccttggtgttactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctcccatgaccagtgacacgtccgcgagcactgtctatatggagatgaggagcctgagacttgacgacacggccgtatattactgtgngagaatcgaagaaggtaggctacaatcacggagtcttttgtaattttggggaccgaagggacaatggtcatcgtctcctcacg

SEQ ID NO: 531592 - DNA, 505 bp, Homo sapiens
  misc_feature: HEFZJCU01CV6Y3.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgttattacgtggttggggagagagtgggtaggtcgatattgtta

SEQ ID NO: 531593 - DNA, 481 bp, Homo sapiens
  misc_feature: HEFZJCU01D95Q3.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgacagcctgagagccgaggacacgggtgtttattactgtgggag

SEQ ID NO: 531594 - DNA, 515 bp, Homo sapiens
  misc_feature: HEFZJCU01CN5YX.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccgagggaaggggctggagtgggtggccagcatgaacggagatggaagtcaaaagaactatgtggactctgtgaagggccgattcaccatctccagagacaacgccaagaactcactgtatctgcaaatgaacacgcctaagacccgaggacacggctgtgtattactgtgcgagagaccgctacgtgggggcccggagcccctggtcc

SEQ ID NO: 531595 - DNA, 523 bp, Homo sapiens
  misc_feature: HEFZJCU01C1P9G.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacggaacgttacctacgctatggacgtctggggccgaacgggaccg

SEQ ID NO: 531596 - DNA, 523 bp, Homo sapiens
  misc_feature: HEFZJCU01DBA3F.48.5.A05.1.454.heavy.3.raw
  modified_base (481)..(481): a, c, t, g, unknown or other
agtatacatacacgaccggtgctcgatttagatagatagacagggggagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctattctgcaaatgaacagcctgagagtcgacgacacggccgtatactactgtgcgagacagatgctgccnctgttccgtggggccagggaccctggtcaccgtctcctcacg

SEQ ID NO: 531597 - DNA, 430 bp, Homo sapiens; identical to SEQ ID NO: 449341
  misc_feature: HEFZJCU01BH3V2.4.37.D04.1.454.heavy.3.raw

SEQ ID NO: 531598 - DNA, 516 bp, Homo sapiens
  misc_feature: HEFZJCU01B1U58.15.67.G01.1.454.heavy.3.raw
  modified_base (474)..(474): a, c, t, g, unknown or other
tctacgtagccacgaccggtgctcgatttagagtatacatattgggtttgaggtctcagagaggagccttagccccggactccaaggcctttccacttggtgatcagcactgagcacagaggactcaccatggagttggggctgagctgggttttccttgttgttattttagaaggtgtccagtgtgaggtgcacttggtggagtctggggaggcttggtccagccgggggggtccctgagactctcctgtgcagtctctggattcacccttagaagttattggatgacctgggtccgccaggctccagggaagggctggagtgggtggccaacataaacaaagacggaagtcagaaaaactatagtggactctgtgaacggccgattcaccatctccagagacaacgccaagaattcactgtatttgcaaatgaacagcctgagaggcgaggacacggccgtgtattattgtncgcgagatgatagtagactctacagtagcagggtggtatgat

SEQ ID NO: 531599 - DNA, 514 bp, Homo sapiens; identical to SEQ ID NO: 511969
  misc_feature: HEFZJCU01BNKII.12.25.C03.1.454.heavy.3.raw

SEQ ID NO: 531600 - DNA, 522 bp, Homo sapiens
  misc_feature: HEFZJCU01BCK0K.48.2.A02.1.454.heavy.3.raw
agtatacatacacgaccggtgctcgatttagactcatctacagggggagtctccctcactgcccagctgggatctcagggcttcattttctgtcctccaccatcatggggtcaaccgccatcctcgccctcctcctggctgttctccaaggagtctgcgcggaagtgcgcctggtgcagtctggagcagtggtgaagaggcccggggagtctctaaagatctcctgtcagggttctgaaggcgactttgacaccttctgggtcgcctgggtgcgccagaggcccggtaaaggactagagtatatgggcgtcatctatcctggtgactccgataccatatatactccgtcgtttcaaggccaggtcaccatgtctgccgacaagtccaagactgtcgcctacctccactgggccaaactgacgtcctccgacagcgccacttattactgtgcgagggtaggcactacgtcttggggtcgagaggacaactggttcgacccgtggggccgagggaaccctggtc

SEQ ID NO: 531601 - DNA, 526 bp, Homo sapiens
  misc_feature: HEFZJCU01A9Y03.49.19.B08.1.454.heavy.3.raw
  modified_base (424)..(424): a, c, t, g, unknown or other
  modified_base (480)..(480): a, c, t, g, unknown or other
agtcgagagacacgaccggtgctcgatttagtgagtcagtaagggggctctgagagaggagcccagccctgggattttcaggtgttttcatgtggtgatcaggactgaacagagagaactcaccatggagtctgggctgacgtggcttttgcttgtggctatcttaaaaggtgtccagtgtgacgtgcagttggtggagtcggggggaggcttggtacagccgggggggtccctgagactctcctgtacagtctctggcttcacctttagagtctatgacatgagttgggtccgccaggctccggggaaggggctggagtgggtctcaacgatcagtgatagtggaactaagacaaactatgccgactccgtgaagggccatgcaccatttccagagacaactcgaaggacactttatatctgnaactcaacagactgacaaccgcggacgcggccgtctattaactgtgtgaaagaaanacggaccgctggacgaggagccagaaggaaaatcaactacttgtaa

SEQ ID NO: 531602 - DNA, 515 bp, Homo sapiens
  misc_feature: HEFZJCU01C5HND.48.12.B01.1.454.heavy.3.raw
agtatacatacacgaccggtgctcgatttagtagtgtagattccgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcgggacaaatccacgggcacagcgcagttggacctgagcggcctgacgacctgaggacacggccatttactactgtgtcgcgggggaggtggacggagctcggttttcggaggtttatcatctactactttgaatc

SEQ ID NO: 531603 - DNA, 513 bp, Homo sapiens
  misc_feature: HEFZJCU01CLJOQ.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacaatggtgtatctgctaaatgaaccagcctgagagccgaaggacgacggggttgttttaatttaactggttggggaaggaaatcctaagtggtcc

SEQ ID NO: 531604 - DNA, 514 bp, Homo sapiens
  misc_feature: HEFZJCU01E0BSS.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgaccgacactgccgtttattttgtacgagagcgtcgtctgtcagtggaattgactactggggccagggaaccctggtcacgtctcc

SEQ ID NO: 531605 - DNA, 522 bp, Homo sapiens
  misc_feature: HEFZJCU01CCG4I.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtaattactgtgcgagagagtggggcccacgacgttactacgactatggacgtcgtggggccaaggggaccg

SEQ ID NO: 531606 - DNA, 520 bp, Homo sapiens
  misc_feature: HEFZJCU01BZME5.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggagggtccctgagactctcctgtgcagcctctggattcgcctctggattgacgttcagtgactactacatgacctgggtccgccaggctccagggagggctggagtgggtttcatacatttatcctagtggtgataccatatactacgcagactctgtgaagggccgattcaccatctccagggacaacgccaagaactcactgactttgcaaatgaacaccctgcgagccgagacacggccgtatacttactgtgcgagaactaaccgttcgccttggttatttaccg

SEQ ID NO: 531607 - DNA, 522 bp, Homo sapiens
  misc_feature: HEFZJCU01AFRBW.40.20.B09.1.454.heavy.3.raw
tctagcgactcacgaccggtgctcgatttagtgtagtgtgaaggggctgagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaagagggactttggggatactactaccggtataggacgtcgtgggg

SEQ ID NO: 531608 - DNA, 558 bp, Homo sapiens
  misc_feature: HEFZJCU01D6VJV.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggaccactgtattactgtactaaatccgcggggtcggccggtcgggcccggtaaccgtccgggtaagttcgggttttggtacgttttcgttggggtccgtacggggaacg

SEQ ID NO: 531609 - DNA, 517 bp, Homo sapiens
  misc_feature: HEFZJCU01CUVAK.16.21.B10.1.454.heavy.3.raw
  modified_base (469)..(469): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggtttcaccatctccagagacaattccaagaacacactgtatctgcaaatgaacagcctgagagccgacggacacggccatatattactgtgcgaaancgaccggcagttagtccacccatactactttagactacgtggggaccg

SEQ ID NO: 531610 - DNA, 492 bp, Homo sapiens; identical to SEQ ID NO: 475994
  misc_feature: HEFZJCU01A1YOU.47.85.H08.1.454.heavy.3.raw

SEQ ID NO: 531611 - DNA, 518 bp, Homo sapiens
  misc_feature: HEFZJCU01BNKO1.40.9.A09.1.454.heavy.3.raw
  modified_base (360)..(360): a, c, t, g, unknown or other
tctagcgactcacgaccggtgctcgatttagcgagacgcgcaggggaggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaagggctggagtttgtggccaagatgaaccacgacggaaatgagaaaaactntgcggactctgtgaagggccgattcaccatttccagagacaacgccaagaagtcactctctctacacatgaccagcctgacagccgaggacaccgggctgtttattactgtgcgaggagatggcacgtcggggcggtgactttgactactggggccac

SEQ ID NO: 531612 - DNA, 527 bp, Homo sapiens
  misc_feature: HEFZJCU01CEPY5.19.86.H09.1.454.heavy.3.raw
  modified_base (483)..(483): a, c, t, g, unknown or other
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaggcataaagtggttcgacccctggggcccagggaaccctggtcaccgtctcctcagcctccaccaagggcccatcggtcttcccctggcgcccngctccaggagcacctccgagacgcacagccggccctggggtccg

SEQ ID NO: 531613 - DNA, 500 bp, Homo sapiens
  misc_feature: HEFZJCU01B444G.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagggcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctgggccagggaaccctggtcaccgtctcctcagcttccaccaaggcccatcggtccttccccc

SEQ ID NO: 531614 - DNA, 495 bp, Homo sapiens
  misc_feature: HEFZJCU01CRWL0.47.85.H08.1.454.heavy.3.raw
  modified_base (440)..(440): a, c, t, g, unknown or other
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgagggggccgattcaccatctccagagacaattcccagaacacggtctatctgcacctgaccancccgtgagaactgaccgacacgtctctctactactgtgcgagagagttgacgagt

SEQ ID NO: 531615 - DNA, 507 bp, Homo sapiens
  misc_feature: HEFZJCU01A94UQ.7.85.H08.1.454.heavy.3.raw
  modified_base (425)..(425): a, c, t, g, unknown or other
cgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccgattcacccacctccagagacgacgccaagaactcactgtctntgcaaatgaacagcctgagagtcggaggaccacggctgtgtattactgtgcgagagacgtccgggaaggggacgtagtgacc

SEQ ID NO: 531616 - DNA, 491 bp, Homo sapiens
  misc_feature: HEFZJCU01C9J24.13.86.H09.1.454.heavy.3.raw
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccgagggcagattcaccatgacgacagacacatacacgaacacagcctacatggaggtgaggagcctgagatatgacgacacggccgtgtattattgtgcgagagtggagtggcagtggatatcgacaattacta

SEQ ID NO: 531617 - DNA, 506 bp, Homo sapiens
  misc_feature: HEFZJCU01DDOGQ.48.68.G02.1.454.heavy.3.raw
agtatacatacacgaccggtgctcgatttagtcgatagtgaagggaaaggggtcgtgagagaggagccttacgccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaaagcactcactgtatctccaaatgaacagcctgagagccgacgacacggctggttgtattactgtgcgagacttgggagagagtggggaccta

SEQ ID NO: 531618 - DNA, 532 bp, Homo sapiens
  misc_feature: HEFZJCU01DR2D0.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagagtcgagtaacgatctcagtggacacgtctaacaatcacctctccctgaggctgagctctgtgacagccgcggacacgggcgtttattactgtgcgagagggacgacgtacggtgactacgtgggggttcgaccccgtggggcccaggggaaccctggtctaccgtctcctcagcctccgaaccg

SEQ ID NO: 531619 - DNA, 513 bp, Homo sapiens; identical to SEQ ID NO: 526842
  misc_feature: HEFZJCU01DXQ8A.15.67.G01.1.454.heavy.3.raw

SEQ ID NO: 531620 - DNA, 514 bp, Homo sapiens
  misc_feature: HEFZJCU01CLDN8.40.68.G02.1.454.heavy.3.raw
tctagcgactcacgaccggtgctcgatttagtcgatagtgaagggaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcgacctactacaacccgtccctcaaaagtcgaggcaccatatccgtagacacgtccaagaaccaattctccctgaagctgagctctgtgaccgccgcagacacggctgtctattactgtgcgacggccccgaagcgcagtggtcttttgatgtcctttgattataggttggggaccaagggacaatggtactaccc

SEQ ID NO: 531621 - DNA, 499 bp, Homo sapiens; identical to SEQ ID NO: 450485
  misc_feature: HEFZJCU01CV06R.11.73.G07.1.454.heavy.3.raw

SEQ ID NO: 531622 - DNA, 519 bp, Homo sapiens
  misc_feature: HEFZJCU01AYOQ0.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttattctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggcccaggggaaccctggtcaccgtctcctca

SEQ ID NO: 531623 - DNA, 473 bp, Homo sapiens
  misc_feature: HEFZJCU01ECQD7.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcaggggtcaccatgaccgagggacacggtccatcagcacagcctacatggaattgagcaggctgtacatctgacgacacggccgtgtattattgtgcgagag

SEQ ID NO: 531624 - DNA, 503 bp, Homo sapiens
  misc_feature: HEFZJCU01CPHT2.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctggggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaacttccaggcacacgctgtatctgcaaatgaacagcctgagagctgaggacacggctgtgtattactgtgcgaaagtatttactatagaggtgacgtac

SEQ ID NO: 531625 - DNA, 506 bp, Homo sapiens
  misc_feature: HEFZJCU01DQL0M.9.12.B01.1.454.heavy.3.raw
tgatacgtctcacgaccggtgctcgatttagtagtgtagattccgtgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagtaactccatgaactgggtccgccaggctccagggaagggctggagtgggtctcagttatttatagcggtggtaacacatactacgcagactccgtgaagggcagattcaccatctccagagacaattccaggaacacgctgtatctcaatgaacagcctgagagtcgaggacacggctgtatattactgtgtcgagagatgtgtacgtctttgatatctggggaccg

SEQ ID NO: 531626 - DNA, 453 bp, Homo sapiens
  misc_feature: HEFZJCU01DR9UH.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtacctatgctatgcactgggtccgccaggctccaggcgaggggctggaggtgggtggcgattatatcacatgatggaactaatagacgctatgccgactccgtgaaggggccgattcaccaatctaccagagacaattccaacgaacacgacacgttatctgacaaatgaacagcccgtagagga

SEQ ID NO: 531627 - DNA, 526 bp, Homo sapiens
  misc_feature: HEFZJCU01CKW23.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacggaagggaggggggaaccgaggacggggagttaccaagtactcctttggacgtcgtc

SEQ ID NO: 531628 - DNA, 513 bp, Homo sapiens
  misc_feature: HEFZJCU01BAFUU.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactgggtggtggttataccacatactacgcagactccgtgaagggccggttcaccatctccagagacaattccaagaacacactgtatctgcaaatgaacagcctgagagccgacgacacggcctatatattactgtgcgaaagcaccggcagttagcacccatactactttgactactcggggaccg

SEQ ID NO: 531629 - DNA, 481 bp, Homo sapiens
  misc_feature: HEFZJCU01A3ITS.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacattatttcatgtaccaacacgtggaatacaaattatgcaccatctgttgagagtcgactgacaatcaacgtagacacatacgaagaaccagttcctccctgcagctcgacctcctgtgaccgtccccggacggacgacgggttacggttattatttac

SEQ ID NO: 531630 - DNA, 504 bp, Homo sapiens; identical to SEQ ID NO: 492527
  misc_feature: HEFZJCU01BOKHN.26.80.H03.1.454.heavy.3.raw

SEQ ID NO: 531631 - DNA, 509 bp, Homo sapiens
  misc_feature: HEFZJCU01DAX7C.52.29.C07.1.454.heavy.3.raw
  modified_base (442)..(442): a, c, t, g, unknown or other
  modified_base (497)..(497): a, c, t, g, unknown or other
cgcagtacgacacgaccggtgctcgatttagagtgctacgaagggaaagggggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcaggtgggtggcatctatatcatatgaaggaagcaataaatactacgcagactccgtgaagggccgattcacatctcagagacaatcccaagaacacactttatctgcaaatgaacaccctgganacttgaggacacgggctcgtacttattattgtgacgagaagggagagtcgaactntaacagtccacg

SEQ ID NO: 531632 - DNA, 507 bp, Homo sapiens
  misc_feature: HEFZJCU01BWUEZ.51.24.C02.1.454.heavy.3.raw
  modified_base (448)..(448): a, c, t, g, unknown or other
cgatcgtatacacgaccggtgctcgatttagtacagatcgttagggaaagggggctctgggagaggagcccagcactagaagtcggcggtgtttccattcggtgatcagcactgaacacagacgactcaccatggactttgggctgagctgggttttcctcgttgctcttttaagaggtgtccactgtcaggtgcagttggtggagtctgggggaggcgcggtccagcctgggaggtccctgaggctctcctgcgcgtcctctggactccccttcagcacttatgacatgcactgggtccgccaggctccaggcaaggggctggagtgggtggcagtcatatcatatgatggaaaggataagtactatgcagactccatgaagggccgatccaccatctccagggacaattccaagaacacactgtatctgcaaataaacaacctganagttgcggacgacgctgtctattactgtgcggcacgtggggggactacggtgacaacgt

SEQ ID NO: 531633 - DNA, 532 bp, Homo sapiens
  misc_feature: HEFZJCU01D2BID.15.87.H10.1.454.heavy.3.raw
  modified_base (457)..(457): a, c, t, g, unknown or other
  modified_base (463)..(463): a, c, t, g, unknown or other
tctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggccaacctggggggtccctgagactctcctgtgcagcctctggattcatctttaatagtttttggatgacctgggtccgccagggtccagggaaggggctggagtgggtggccaacataaagcaagatggaagtggagaaatactatgtggactctgtgaagggccgattcaccatctccagagacaacgccaagaacttactgtatctgcaaatgaacagcctgagaggcgagganacggcnctgtattactgtgcgaggataccttcctctgggcgggcctacgggtttcctacgggctagtaggtcgtc

SEQ ID NO: 531634 - DNA, 530 bp, Homo sapiens; identical to SEQ ID NO: 455130
  misc_feature: HEFZJCU01EF34M.7.78.H01.1.454.heavy.3.raw

SEQ ID NO: 531635 - DNA, 508 bp, Homo sapiens
  misc_feature: HEFZJCU01CM2KG.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaagggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgtagttttggtttgggcggggtataggcagcgggtaccc

SEQ ID NO: 531636 - DNA, 500 bp, Homo sapiens
  misc_feature: HEFZJCU01A98KM.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcacgaagatgaagggcagagtcacgaattaccaggaccaccccacgaacacagtctacatgcaactgacgagcctgagagctgacgacacggccgtctattactgtgcgagaatgttttctgtcatcgtacatttgataggctctatggtactggacttgtc

SEQ ID NO: 531637 - DNA, 498 bp, Homo sapiens
  misc_feature: HEFZJCU01BHUMS.14.25.C03.1.454.heavy.3.raw
cgtctagtaccacgaccggtgctcgatttagtagtgtagatttgggtttgggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagacgacaattccaagaacacgcagtatctgcaatgaacagcctgagagctgaggacacggcgtgtgtattactgtgggagagatgggaggtcgatattagtta

SEQ ID NO: 531638 - DNA, 524 bp, Homo sapiens
  misc_feature: HEFZJCU01A613X.49.59.F04.1.454.heavy.3.raw
agtcgagagacacgaccggtgctcgatttagtacacacacttagggattggggacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggatccccgcgtttcgaggatgactaccgtggggccacggggaaccctggtccaccggtctccg

SEQ ID NO: 531639 - DNA, 497 bp, Homo sapiens
  misc_feature: HEFZJCU01BU58P.53.73.G07.1.454.heavy.3.raw
cgcgtatacacacgaccggtgctcgatttagctctacgctcagggggcatcatccaacaaccacatcccttctctacagaagcctctgagaggaaagttcttcaccatggactggacctggagggtcttctgcttgctggcagtagctccaggtgctcgctcccaggtgcagctggtacaatcgggggctggagatgaagaagcctggggcctcagtgatgatttcctgcacgacatctggatacaccttcaccgactcccttatacattgggtacgacacggcccctggacaggggcttgagtggatgggtctaatcaaccctagtggtggatctacaagttactcacagagaatgcaggggccgaaattacccatgaccagagacacgtccaacgagtacagtctacatggaggtgagcagcctgagatctgaggacacggccagtgtatttactgttgcgtatcttagtggaattacgactacaattattttgt

SEQ ID NO: 531640 - DNA, 506 bp, Homo sapiens
  misc_feature: HEFZJCU01EE75E.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgagggcgattcaccatctccagagacgattccaagaacacgttgtatcttcaatgaacagcctgacagtcgacgacacggccactgtatttttgttgcgagccgaccggggctcctcaatggctttcattacg

SEQ ID NO: 531641 - DNA, 503 bp, Homo sapiens
  misc_feature: HEFZJCU01DJ6ET.48.23.C01.1.454.heavy.3.raw
agtatacatacacgaccggtgctcgatttagtacacgtgattagggattggggacccaacaaccacatccctcctcagaaggccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagagtcggaagacgacggcagtatattactgtgcgagaggcgggatagttgtcgtcgaggtgacgtgctacagtacaaaatcgt

SEQ ID NO: 531642 - DNA, 393 bp, Homo sapiens
  misc_feature: HEFZJCU01AV2WZ.52.45.E01.1.454.heavy.3.raw
cgcagtacgacacgaccggtgctcgatttagtgagtcagtaagggaaaggggctggagtgggtttcatacagtagtggttctagtactttcgcaaagtacgcagactctgtgaagggccgattcaccgtgtccagagacaacgccaagaactcaatgtatctgcagatgagcaacctgagagtcgacgacacggctgtttattactgttcgagactagcggatttttgggggtcggaatcacttgactactggggccagggagccctggtcaccgtctcctctgcctccaccaagggcccatcggtcttccccctggcaccctcctccaagagcacctctgggggcacagcggccctgggctgcctggtcaaggactacttcctatacgatcg

SEQ ID NO: 531643 - DNA, 433 bp, Homo sapiens
  misc_feature: HEFZJCU01EFJLI.17.10.A10.1.454.heavy.3.raw
cgtagactagcacgaccggtgctcgatttagcgtcgatctcaggggacccaaaaaccacacccctccttgggagaatcccctagatcacagctccttcaccatggactggaccctggagcatccttttcctggtggcagcaggcgacaggtgcccacgcccaggttcagttggtgcagactggggctgaggtgcagaagcctggggcatcgagtgactgtctcctgcaaggccagtggatatatcttcacaaaataatggtatgaattggtgcgacacggccccggacaagggcttggagtggggtggggtggggtcgagcggcttttggacggtaagggcacaggtattgaccgaccgaaggagttaggaaacgggcaggaagtcctaacggaatttaccaccgggaaccacccccaccgaaaccacaagtc

SEQ ID NO: 531644 - DNA, 501 bp, Homo sapiens
  misc_feature: HEFZJCU01EPZCX.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgaagatgttttctgtcatcgtacaatttgagtaggctctatggatgacttcgtc

SEQ ID NO: 531645 - DNA, 512 bp, Homo sapiens
  misc_feature: HEFZJCU01EL5YY.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtggggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctagaatactggggccaggaaccctggtcgtccg

SEQ ID NO: 531646 - DNA, 506 bp, Homo sapiens
  misc_feature: HEFZJCU01ELZMJ.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccggtgagcctacggcagcggcctttgacttcgtcggggtccg

SEQ ID NO: 531647 - DNA, 502 bp, Homo sapiens
  misc_feature: HEFZJCU01EGQG2.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaattagtgacttctattcagactccgtgaagggccgattcaccgtctccagagacaattccaggcacacgcctgtatctgcaaatgaacagcctgagagctgagacacggctgtgtattactgtgcgaaagtatttactatagaggtgacgtacgggggtcgttc

SEQ ID NO: 531648 - DNA, 509 bp, Homo sapiens
  misc_feature: HEFZJCU01CMJ3Q.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaacctcctactacggtctggacgtcgtgggcc

SEQ ID NO: 531649 - DNA, 513 bp, Homo sapiens
  misc_feature: HEFZJCU01CUOMN.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttcctgttgctattttaaaaggtgcccagtgtgaggtgcagctggtggagtctggaggaggcttgatccagcctggggggtccctgagactctcctgtgcagcctctgggttcaccgtcagtcacactacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgattactgtgcgagagagtggggcccacgaacgttactacgctatggacgtctggggaccgg

SEQ ID NO: 531650 - DNA, 486 bp, Homo sapiens
  misc_feature: HEFZJCU01A57AH.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaaccatctccagagacaattccaagaacatggtgtatctgcaaatgaccagcctgagagccgaggacacggtgtttatactgtggagaaatcta

SEQ ID NO: 531651 - DNA, 491 bp, Homo sapiens; identical to SEQ ID NO: 444592
  misc_feature: HEFZJCU01CLMZK.11.26.C04.1.454.heavy.3.raw

SEQ ID NO: 531652 - DNA, 361 bp, Homo sapiens
  misc_feature: HEFZJCU01B2B5Y.7.71.G05.1.454.heavy.3.raw
cgtgtctctacacgaccggtgctcgatttagtgtcgtcgcaagagagaggggggggagaggagcccagcactagaagtcggcggttgtttccattcggtgatcagcactagaacacagaggactcaccatggagtttgggctgaactggttttcctcgttgctcttttaagaggtgtccagtgtcaagtgcaactggtggagtcgtggggagcgtggtccagccgtgggagtcacgagagactctcctggtgcacgcctcgtgggttccaccgttcagtagcgtacggcatgccacgtcgggtccgaccaacgtctccgaggaccgaagggtattgggaggttggggtcggcctaggtttt

SEQ ID NO: 531653 - DNA, 505 bp, Homo sapiens
  misc_feature: HEFZJCU01DR66S.17.25.C03.1.454.heavy.3.raw
  modified_base (438)..(438): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcacccatcctccgggacagacttaccatgaccacgaactcctaccataaacacagcctacatggagttgaggagcctgaccatctgacganacggcgtctattctgtgcgagcgtccacgatccggtgacgcctacggcagcggcctttgacttcgtc

SEQ ID NO: 531654 - DNA, 508 bp, Homo sapiens
  misc_feature: HEFZJCU01B6MFU.17.10.A10.1.454.heavy.3.raw
  modified_base (479)..(479): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggaacacccccacgaacacagtctacatgcaactgacgagcctgagagctgaacgacacggccgtcgtattactgtgcgagaatgttttctgtcatcgtacaatttnataggctctagtggtactggactttcgtc

SEQ ID NO: 531655 - DNA, 499 bp, Homo sapiens
  misc_feature: HEFZJCU01B7XDS.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagtaggttttagtgatacttattgtagtggtggtacctgcttacgtttttc

SEQ ID NO: 531656 - DNA, 520 bp, Homo sapiens
  misc_feature: HEFZJCU01C07WK.4.33.C11.1.454.heavy.3.raw
  modified_base (434)..(434): a, c, t, g, unknown or other
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcgattagagccatggcttatgctgggacaacagaatacgccgcgtctgtgaaaggcagattcatcatctcaagagatgattccaacggcatcgcctatctncagatgaacagcctagagaccgagacgacagccgtctattactgtgttagggtagttttacgtatttttaggtagtggatatttaa

SEQ ID NO: 531657 - DNA, 500 bp, Homo sapiens; identical to SEQ ID NO: 446033
  misc_feature: HEFZJCU01DFXY2.11.27.C05.1.454.heavy.3.raw

SEQ ID NO: 531658 - DNA, 533 bp, Homo sapiens
  misc_feature: HEFZJCU01B3WN9.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccgagggaaggggctggagtgggtggccaacataaagtacgatgaagttgagataaattatttggactctgtgaagggccgattcaccatctcgagggacaacgccaagaactcgctgtatctgcaaatggagagcctgagagccggaggacacggctgtatattattgtgtgagattagcgcactactttgactagtacggggccagggaaccctggtcaccgt

SEQ ID NO: 531659 - DNA, 527 bp, Homo sapiens
  misc_feature: HEFZJCU01BOVER.9.78.H01.1.454.heavy.3.raw
  modified_base (469)..(469): a, c, t, g, unknown or other
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccagggaaccctggtcaccgtctcctcagcctccaccaagggcccatcggtcttcccctggcgccctgctccngagcacctccgagagcacagcggcccgtcgggctgcctggtcaaggactacttccacg

SEQ ID NO: 531660 - DNA, 497 bp, Homo sapiens
  misc_feature: HEFZJCU01CC5B2.51.1.A01.1.454.heavy.3.raw
cgatcgtatacacgaccggtgctcgatttagacgtctcatcaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacaacgggtccgg

SEQ ID NO: 531661 - DNA, 495 bp, Homo sapiens
  misc_feature: HEFZJCU01CPHFG.49.80.H03.1.454.heavy.3.raw
agtcgagagacacgaccggtgctcgatttagctgtgcgtcgaagggaaagggggcatcatccaacgaccacatcccttctctacagaagcctctgagaggaaagttcttcaccatggactggacctggagggtcttctgcttgctggctgtagctccaggtgctcactcccaggtgcggctggtgcagtctgggtctgaggtgaagaagcctggggcctcagtgaaggtttcctgcaagacatctggatacaccttcaccaactactatatgcactgggtgcgacaggcccctggacaggggcttgagtggatggggataatcaaccctggtatcatctaccctggtcgtagtcagacaacgtacgcgcaggaacttccagggcagagtcaccgtgaccagggacacgtccacgagcacagtctatatggagctgagcagcctgagatctgaggacacgggccgtgtattactgtgcgagactaccaaattactt

SEQ ID NO: 531662 - DNA, 512 bp, Homo sapiens
  misc_feature: HEFZJCU01BW9VY.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctagttactgtgcgagagtcccacgatccggtgacgcctacggcaggccggccttttagactttcgtac

SEQ ID NO: 531663 - DNA, 535 bp, Homo sapiens
  misc_feature: HEFZJCU01DLGK2.12.12.B01.1.454.heavy.3.raw
  modified_base (353)..(353): a, c, t, g, unknown or other
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtagtctattttagcgggagcacctaccagaacgcgtccctcaagagtcgaatcaccatntcggtggacacatcgaagaaccagatctcccttaagttgaggtctgtgaccgccgctgacacggccgtctattactgtgcgagagtccgtgctggaagaactactttttttgacttattggggccagggaatctggtcaccgtcgcctcagcctccaccaacgggcccatcggtccttcccc

SEQ ID NO: 531664 - DNA, 499 bp, Homo sapiens; identical to SEQ ID NO: 485338
  misc_feature: HEFZJCU01DILOA.11.27.C05.1.454.heavy.3.raw

SEQ ID NO: 531665 - DNA, 506 bp, Homo sapiens
  misc_feature: HEFZJCU01A1D6S.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacaatcttgtatcttcacaatgcacaatctgagagtcgacgacacggccacctattattgtgtcgcgacatgactacgctcattctggggccagggacg

SEQ ID NO: 531666 - DNA, 532 bp, Homo sapiens
  misc_feature: HEFZJCU01CN0X1.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatggtaggaaaaagtataggctgtgtttattggggccagggagccctggt

SEQ ID NO: 531667 - DNA, 518 bp, Homo sapiens
  misc_feature: HEFZJCU01CXRFD.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaacagcggagttccaagtactcctttgacgtctggggccgtac

SEQ ID NO: 531668 - DNA, 490 bp, Homo sapiens
  misc_feature: HEFZJCU01A18QO.52.85.H08.1.454.heavy.3.raw
cgcagtacgacacgaccggtgctcgatttagtatcactcagtcgcggggtatcactcagtcgcggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaccacttctccctgaagctgacctctgtgactgccacagacacggccgtctattactgtgccagagggatcgctagaggtgctcattcgtttagctcc

SEQ ID NO: 531669 - DNA, 559 bp, Homo sapiens
  misc_feature: HEFZJCU01ELO40.12.14.B03.1.454.heavy.3.raw
atacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcatttttccttttggctattttaaagggtgtccagtgtgaagtgcacttggaacagtcggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaacgggccgattcatcacttctagagacaacgccgagaactccctgtatctgcagatgaacagtctgagacctgaggacacggccctgtatttctgtttacgaaaagggggcttcgtggttcgaaggggagtggggggtcttttggaccttcctcgggggccccgagggaaccccgttc

SEQ ID NO: 531670 - DNA, 537 bp, Homo sapiens
  misc_feature: HEFZJCU01ALV11.14.57.F02.1.454.heavy.3.raw
  modified_base (302)..(302): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttntccatctccagagacaattccaagaacactctatttcttcaaatggacagcctgaaagacgaagacacgggcgtgtatttttgtgtgaaagatacgaagtctatgatacccaatttgggaggggcctttcatgtctggggccagggacgctggtcaccgtctcttcagcctccaccaagggcccatcggtcttcccctggccaccctcctccaagagcacctctggggcacagcc

SEQ ID NO: 531671 - DNA, 523 bp, Homo sapiens; identical to SEQ ID NO: 471774
  misc_feature: HEFZJCU01BA173.3.82.H05.1.454.heavy.3.raw

SEQ ID NO: 531672 - DNA, 534 bp, Homo sapiens
  misc_feature: HEFZJCU01EYCRF.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaatgggcgggtggctacgacttgtacgttttgggccgagggaaaccgtggtcaccgtcctccccacgccttccaccgaacgggcccactcgttccttcccccg

SEQ ID NO: 531673 - DNA, 536 bp, Homo sapiens
  misc_feature: HEFZJCU01D3YTA.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaataacgggaaaccgtttgactttggggccagggaacctggtcaccgtctcctcagcctccaccaaggcccatcggtcttcccctggcaccctcctccaagagcacctctcgggggcacacgccgggccctgggtctcgcctc

SEQ ID NO: 531674 - DNA, 521 bp, Homo sapiens
  misc_feature: HEFZJCU01B5V5C.13.76.G10.1.454.heavy.3.raw
tcacgtactacacgaccggtgctcgatttagtcactcatacagggggggagaggagcccagctactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacagtactccgcagactccgtgaggggccgattcaccatctccagagacaattccaagaacacgctgttcttcaatgaacagcctgagagccgatgacacggccgtgtattactgtgcgagagatggggcccacgaacgttactacgctatgggacgtcgtggggccaaggggaccg

SEQ ID NO: 531675 - DNA, 495 bp, Homo sapiens
  misc_feature: HEFZJCU01BHOB1.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtataca

SEQ ID NO: 531676 - DNA, 512 bp, Homo sapiens
  misc_feature: HEFZJCU01EBTDS.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagccctgacatctgacgacacggccgtctattactgtgcgagagtcccacgatccggtgagcctacggcagcggcctttgactttctgggggccaggggacg

SEQ ID NO: 531677 - DNA, 531 bp, Homo sapiens
  misc_feature: HEFZJCU01CTLTQ.47.6.A06.1.454.heavy.3.raw
agctcacgtacacgaccggtgctcgatttagatctactgacagcacacaagggggggaaatacttttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtcccccagggaagggactggagtggattgggtataattattacaagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttgataaactggggccagggggatccgtggtcaccgtctcctcagcctccaccaac

SEQ ID NO: 531678 - DNA, 524 bp, Homo sapiens
  misc_feature: HEFZJCU01BGBM8.16.35.D02.1.454.heavy.3.raw
  modified_base (477)..(477): a, c, t, g, unknown or other
tgtactactccacgaccggtgctcgatttagcacacgatagttgggttttgggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccgggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcaagcctggaggcctcggacaccgccatatattactgtgcgagtccggttatcgcgcagntcactactactactacggtcgtggacgtcgtggggccaagggacccg

SEQ ID NO: 531679 - DNA, 485 bp, Homo sapiens
  misc_feature: HEFZJCU01BEAHH.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctcccttgcagctgacctcctgtgactcccgacgacgacgggtgtatattactgtggaagaggccccactacga

SEQ ID NO: 531680 - DNA, 516 bp, Homo sapiens
  misc_feature: HEFZJCU01AYEHJ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtcttcccctgcaccctcctccaagagcacctctgggggcacgagcggccctgggctgcctggtcaaggactacttccagacgtatca

SEQ ID NO: 531681 - DNA, 529 bp, Homo sapiens
  misc_feature: HEFZJCU01EODYO.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggtccgaagggacctacc

SEQ ID NO: 531682 - DNA, 504 bp, Homo sapiens
  misc_feature: HEFZJCU01ETCRM.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggccggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagatcgacgacacggccacctattattgtgcgcgacatgactacgctcaattctgggggtccagggg

SEQ ID NO: 531683 - DNA, 513 bp, Homo sapiens
  misc_feature: HEFZJCU01A30PJ.9.64.F09.1.454.heavy.3.raw
tgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgaggagataaaaagtggggcaggggaaccctggtcaccgtctcctc

SEQ ID NO: 531684 - DNA, 505 bp, Homo sapiens
  misc_feature: HEFZJCU01A0JW4.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccgattcaccacctccagagacgacgccaagaactcactgtctctgcaatgaacagcctgagagtcgaggacacggctgtgtattactgtgcgagagagtccgggagggggaccgttagtgaccc

SEQ ID NO: 531685 - DNA, 501 bp, Homo sapiens
  misc_feature: HEFZJCU01EOVVF.11.27.C05.1.454.heavy.3.raw
  modified_base (488)..(488): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatntacggaccccgat

SEQ ID NO: 531686 - DNA, 512 bp, Homo sapiens
  misc_feature: HEFZJCU01BAH3F.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatgaccacgaactcctccataaacacagcctacagtggagttgaggagcctgacatctgacgacacggccgtctattctgtgcgagacggtcccacgatcccggtgacgcctacggccaggccggtccctttgactttctc

SEQ ID NO: 531687 - DNA, 502 bp, Homo sapiens
  misc_feature: HEFZJCU01DS0MW.53.62.F07.1.454.heavy.3.raw
cgcgtatacacacgaccggtgctcgatttagtagtcgcataaagggaaaggggtagtcgcataaagggaaagggggaggtgtgtcacaagatttgggctctgggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggagcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacac

SEQ ID NO: 531688 - DNA, 528 bp, Homo sapiens
  misc_feature: HEFZJCU01A8G2T.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacggtcccacgacgtcccgggtgacggccctaaccgggtcacggccggtcccttttggaccttttccgtc

SEQ ID NO: 531689 - DNA, 508 bp, Homo sapiens
  misc_feature: HEFZJCU01EZC7M.48.82.H05.1.454.heavy.3.raw
agtatacatacacgaccggtgctcgatttagtcgagctctctcgcgggcacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcacatatccgtagacacgtccaagaaccagttctccctgaagctgagctctgtgaccgccgcagacacggctgtgtattactgtgcgagggggccggggatagtttgttatagtaaccaccctgct

SEQ ID NO: 531690 - DNA, 516 bp, Homo sapiens
  misc_feature: HEFZJCU01EF9X9.2.53.E09.1.454.heavy.3.raw
acgctcgacacacgaccggtgctcgatttagagagagtgtgttgggtttggggccccctagatcacagctcctcaccatggactggacctggagcatcctttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtattattgtgcgagaggacggagggggggagcggacgccttttgactacgtggggccacgggaacccgtggtcaccgtcctcctcagcctccaccgaacggg

SEQ ID NO: 531691 - DNA, 515 bp, Homo sapiens
  misc_feature: HEFZJCU01BG144.49.11.A11.1.454.heavy.3.raw
agtcgagagacacgaccggtgctcgatttagctacgactgcagggggagaggagccccagccttgggattcccaagtgttttcattcagtgatcaggactgaacacagaggactcaccatggagtttgggctgacctggattttccttgctgctattttaaaaggtgtccagtgtcaggtccagctggtggagtctgggggaggcttggtaaggcctggggggtcccttagactctcctgtgcagcctctggattcaatttcaatgacgcctggatgagctgggtccgacaggctccagggaaggggctggagtgggttgcccgtattaaaagcagagttgatggtgggacaagagagtacgctgcgaccgtgaaaggcagagtcagcatctcaagagatgattcaagagacacggtgtttctgcaattgacagcctgaaaacggaggacacagccgtgtattactgtgccacgtggcaccatggatacgcctattcttaacaagagggacttcg

SEQ ID NO: 531692 - DNA, 500 bp, Homo sapiens
  misc_feature: HEFZJCU01C5XD7.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctagtgttattactgtgcgaaagatttcatagaggtgacgtac

SEQ ID NO: 531693 - DNA, 548 bp, Homo sapiens
  misc_feature: HEFZJCU01BYOCJ.49.24.C02.1.454.heavy.3.raw
agtcgagagacacgaccggtgctcgatttagtacagatcgttagggaaaggggacccaaaaaccacacccctccttgggagaatcccctagatcacagctcctcaccatggactggacctggagcatccttttcttggtggcagcagcaacaggctcccactcccacttttatttgatgcagtctggggctgaggtgaagaagcctggggcctcagtgaaggtctcctgcacggcctctggtaacacctttaccagtcatggtattatctgggtgcgacaggcccctggacaagggcttgagtggatgggatgggtcagccctttcaatggtgagacaaactatgcacagaaactccagggcagagtcaccatgaccacagacacatccacgaccacagcctacatggagttgaggagcctgagatctgacgacacggccgtttatttctgtgcgagaggggggggccgtaccggagtttaggcgtggttatcttagggtttgtaccggagtggggccgagggaacccccggtccgacccgtctcccg

SEQ ID NO: 531694 - DNA, 496 bp, Homo sapiens
  misc_feature: HEFZJCU01D7L4P.40.81.H04.1.454.heavy.3.raw
tctagcgactcacgaccggtgctcgatttagtagtgtagattcgcggggatcacccagcaaccacatctgtcctctagagaatcccctgagagctccgttcctcaccatggactggacctggaggatcctcttcttggtggcagcagccgcaggagcccactcccaggtgcagctggtgcagtctgggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctacgcggggctgaccacgtggggcc

SEQ ID NO: 531695 - DNA, 491 bp, Homo sapiens
  misc_feature: HEFZJCU01DX7W4.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgagggacacggctgtgtattactgtgggagtcctggctggcacctgtatccgaccgttggagtcagggaactctggtcaccgtctcctcagcctccaccaagggcccatcggtcttcccctggcgccctgctccaggagcacctccgagagcacagcgcccgtgggctgcctggtcaaggactacttccgtatctctcg

SEQ ID NO: 531696 - DNA, 324 bp, Homo sapiens
  misc_feature: HEFZJCU01B8QLV.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggatacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 531697 - DNA, 520 bp, Homo sapiens
  misc_feature: HEFZJCU01ERH7X.12.11.A11.1.454.heavy.3.raw
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggacgtcctacggtgacaaatttattcaaaccagaacaaagttcg

SEQ ID NO: 531698 - DNA, 533 bp, Homo sapiens
  misc_feature: HEFZJCU01EUO6K.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaaagaacacactatatctgcagattgacagtctgagacccgaggacacggctgtgtattactgtgcaggcagttcgtggaaacagttatgggttggggggagttggggttttttttcgttacgttacgggt

SEQ ID NO: 531699 - DNA, 520 bp, Homo sapiens
  misc_feature: HEFZJCU01BCF02.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggcaggggaccctggtcatcgtctccccagcctccaccaacggcccatcggtcttcccctggcg

SEQ ID NO: 531700 - DNA, 504 bp, Homo sapiens
  misc_feature: HEFZJCU01BYDEE.49.82.H05.1.454.heavy.3.raw
  modified_base (436)..(436): a, c, t, g, unknown or other
agtcgagagacacgaccggtgctcgatttagtcgagctctctcgcgggggctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggcttccgagggaagggactgggagtgggtttcatacattagtcggagagtcaacaccgtattctacacagactctgtgaggggccgattcaccatctccagagacaacgccaagaactcactgtatctccaaatnaacagccctgagagtcggaggacgacggctgtctattactgtggcgagagatcccaacaggccggtcg

SEQ ID NO: 531701 - DNA, 536 bp, Homo sapiens
  misc_feature: HEFZJCU01D1MPR.13.26.C04.1.454.heavy.3.raw
tcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcggacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaagggacggttttggggtcggcggacgtcctcttgagtatcgtggggccgagggggacaagtggtccgaccgtcctc

SEQ ID NO: 531702 - DNA, 501 bp, Homo sapiens
  misc_feature: HEFZJCU01BVUN4.12.38.D05.1.454.heavy.3.raw
  modified_base (453)..(453): a, c, t, g, unknown or other
atacgacgtacacgaccggtgctcgatttagtatctgatagttgggtctggggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccggtctcctcagcctccaccaagggcccatcggtcttcccctggcgccctgctcaggagcacctccgagancacagcggccctgggctgcctggtcaaggactacttcctacgtcgtat

SEQ ID NO: 531703 - DNA, 469 bp, Homo sapiens
  misc_feature: HEFZJCU01CKE3B.12.78.H01.1.454.heavy.3.raw
atacgacgtacacgaccggtgctcgatttagtgtgagtagtttgggtttggggggaagaggaagactgacggtccccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagtctccaccaagggcccatcggtcttccccctggcaccctcctccaagagcacctctgggggcacagcggcctgggctgcctggtcaaggactacttcctacgtcgtat

SEQ ID NO: 531704 - DNA, 503 bp, Homo sapiens
  misc_feature: HEFZJCU01D2R6I.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacggtggcagctccaagtactactttgacttctggggccagggaaccctggtcaccgtctcctcagcctccaccaagggcccatcagtcttcccctggcgccctgctccaggagcacctccgagacgcaacagcggcctgggctgcctgtcaaggactactccagacgtatca

SEQ ID NO: 531705 - DNA, 499 bp, Homo sapiens
  misc_feature: HEFZJCU01AYTIM.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctagagacctgaggacacggccctgtatttctgttcaaaaggggctctggttcagggatggggctttgactcctgggcccagggaaccctggtcgcggtctcctcagcctccaccaagggcccatcggtcttccccctggcaccctcctccaagagcacctctggggcacagcggccctgggctgcctggtcaaggactacttcctacgtcgtat

SEQ ID NO: 531706 - DNA, 532 bp, Homo sapiens
  misc_feature: HEFZJCU01C2FGF.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggggtccctgagactctcctgtgcagcctctgggtttcaccgtcagtcacacctacatgagttgggtccgccaggctccagggaagggggctggagtgggtctcctttatttacagcagtggtagtacatattccgcagactccgtgagggccgattcaccatctccagagacaactctaagaacacgctgtttcttcaaatgaacagcctgagagccgatgacacggccgtgtattactgtgcgagagatgggggcccacgtaacgttactacgctatggacgtctggggcccaagggacctac

SEQ ID NO: 531707 - DNA, 525 bp, Homo sapiens
  misc_feature: HEFZJCU01C73YA.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacaccccaaaaaccaggtggtccttacaatgaccaccatggaccctgtggacacagccacatatttctgtgcacactctataggagcacctggtagtctgccaactggttcgaccctgggcccgggaacctggtcacgtctcctcagcctcaccaaggcccatcggtctcccctc

SEQ ID NO: 531708 - DNA, 516 bp, Homo sapiens
  misc_feature: HEFZJCU01BSEXK.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacaactgtatctgcaaatgaacagcctgagagccgacgacacggccatatattaactgtgcgaaaggcaccggcagttagtcacccatactactttgacttacgtggggaccg

SEQ ID NO: 531709 - DNA, 553 bp, Homo sapiens
  misc_feature: HEFZJCU01B9TDU.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattacggaagttgcattcgagtaaaaggaggactatgcttttggatatctggggcccaggggacaagttc

SEQ ID NO: 531710 - DNA, 533 bp, Homo sapiens
  misc_feature: HEFZJCU01EPRBB.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgagtccgtcattgtcgcggacacagccgtctattattgtgtcagagatccggccataactggctcgccctggggcccggaaccctggtcaccgtctcctcagcctccaccaagggcccatcggtccttcccctggccaccctcctccaagacg

SEQ ID NO: 531711 - DNA, 550 bp, Homo sapiens
  misc_feature: HEFZJCU01CYHR9.16.39.D06.1.454.heavy.3.raw
  modified_base (535)..(535): a, c, t, g, unknown or other
tgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggctgacccagccgggggggtccctgagactctcctgtgcagcctctgggttcagcgtcagtaacaaccacgtgatgtgggtccgccagcctccagggaagggctggaatgggtctcagttattgaaaatgatggtgacacaatctacgccgactccgtgaagggccgattcaccatctccagagacaattccaagaacacggtgaatcttcaaatgaacagacctgagaaccgaggacacggccgtatattattgtataggttatggtggtaaagttcgggcccttggggcacgggaaccggtggtcgaccgtcgtccttcganccgtccaaccaaacc

SEQ ID NO: 531712 - DNA, 528 bp, Homo sapiens
  misc_feature: HEFZJCU01B0S2N.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaaggcctggagtggattgggaacatctattacagcgggagcaccaactacaaccgtccctcaagagtcgagttaccatttcattaaacacgtctaagaaccagttctccctgaagctgacctttgtgactgccgcggacacggccgtgtattactgtgcgagagacccctccgactagcagtggctggtccacttaggtttgactacgtgggggtccagggaagctttggtccaccgtctcctcagccttcc

SEQ ID NO: 531713 - DNA, 396 bp, Homo sapiens; identical to SEQ ID NO: 444469
  misc_feature: HEFZJCU01A3J2J.47.46.E02.1.454.heavy.3.raw

SEQ ID NO: 531714 - DNA, 510 bp, Homo sapiens; identical to SEQ ID NO: 455775
  misc_feature: HEFZJCU01BSL81.4.33.C11.1.454.heavy.3.raw

SEQ ID NO: 531715 - DNA, 423 bp, Homo sapiens; identical to SEQ ID NO: 444772
  misc_feature: HEFZJCU01CWOM5.16.78.H01.1.454.heavy.3.raw

SEQ ID NO: 531716 - DNA, 532 bp, Homo sapiens
  misc_feature: HEFZJCU01BLTIP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaaacaccctttatctgcaaatagacagcctgagaccagaacgacacggctgtctattattgcgcgagagagacacacgaacctactggccaatactatgggggcttgttctggggtccaggggaccctggtcatcgtctccccacgcctcccaccaagggcccagtcggtcctttccccctgggccg

SEQ ID NO: 531717 - DNA, 486 bp, Homo sapiens
  misc_feature: HEFZJCU01AZOB8.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctggggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgacgacagcctacatagagctgcgccagcctgagatctgaagacacggccatttatactgtgcgagagatgcagggccctcccacactcggttta

SEQ ID NO: 531718 - DNA, 467 bp, Homo sapiens
  misc_feature: HEFZJCU01E0SYU.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggaccagggaaccctggtctccgtctcgtcagcctccaccaagggcccatcggtcttccccctggcgccctgctccaggagcacctccgagagcacagcggccctgggctgcctggtcaagggactacttcccacgagagta

SEQ ID NO: 531719 - DNA, 530 bp, Homo sapiens
  misc_feature: HEFZJCU01AMQEV.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagagtcgagtaacgatctcagtggacacgtctaacaatcacctctccctgaggctgagctctgtgacagccgcggacacgggcgtttattactgtgcgagagggacggactacggtgactacgtgggggttacgaccccgtggggcccgagggaaccctggtcaccgtctcctcagcctccaccg

SEQ ID NO: 531720 - DNA, 499 bp, Homo sapiens
  misc_feature: HEFZJCU01ADVZZ.40.81.H04.1.454.heavy.3.raw
  modified_base (438)..(438): a, c, t, g, unknown or other
  modified_base (446)..(446): a, c, t, g, unknown or other
  modified_base (453)..(453): a, c, t, g, unknown or other
  modified_base (461)..(461): a, c, t, g, unknown or other
  modified_base (470)..(470): a, c, t, g, unknown or other
  modified_base (489)..(489): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgactcgtgacganacggcatntattacngtggaagngacgttggngctaccggcgggctgaccncgtcgggccg

SEQ ID NO: 531721 - DNA, 524 bp, Homo sapiens
  misc_feature: HEFZJCU01EOJUZ.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagatggggcccacgaacgttactacgctatggacgtcgtggggccaagggacccg

SEQ ID NO: 531722 - DNA, 488 bp, Homo sapiens
  misc_feature: HEFZJCU01BTU4W.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccgagggacacgtcccatcagcacagcctacatggagctacacggcctgagatctgacgacaccggccctgttatttttgtgtcgagagagtctattaaagtgg

SEQ ID NO: 531723 - DNA, 509 bp, Homo sapiens
  misc_feature: HEFZJCU01A6LZA.13.76.G10.1.454.heavy.3.raw
  modified_base (138)..(138): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagcngggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggactcgtgggg

SEQ ID NO: 531724 - DNA, 495 bp, Homo sapiens
  misc_feature: HEFZJCU01B4B74.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacgttatttacagtggcggcactacatactacacagacttcgcgaggggccgattcaccatctccagagacgattccaagaacacgttgtatcttcaaatgaacagcctgacagtcgacgacacggccatgtatttttgtgtcgagcgacccggggctcctcat

SEQ ID NO: 531725 - DNA, 504 bp, Homo sapiens
  misc_feature: HEFZJCU01AN7GG.12.38.D05.1.454.heavy.3.raw
atacgacgtacacgaccggtgctcgatttagtatctgatagttgggtttgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacaggccggccctggggctgcctggtaaacggactacttcctacgtcgtat

SEQ ID NO: 531726 - DNA, 523 bp, Homo sapiens
  misc_feature: HEFZJCU01EWI1A.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaacagttctccctgaagctgaggtctgtgactgccgcagacacggccgtctactactgtgccaggtgggctttggcgccagtggttcagagatggatcgtcgtttcgagtttcggtcggggggtccgaggggtaacgttcg

SEQ ID NO: 531727 - DNA, 470 bp, Homo sapiens
  misc_feature: HEFZJCU01BJZVW.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccgggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgctggtcaaggactacttccctacagtgct

SEQ ID NO: 531728 - DNA, 521 bp, Homo sapiens
  misc_feature: HEFZJCU01EG9K1.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagctgaggacacggccgtatattactgtgcgagaataacccgttcgcctggttattaccttgacacttggggccagggaaccctggtcaccgtctcctcagcctccaccaagggcccatcggtcttcccctcggcgccctgctccaggagcacctccgagagcacagcgccctggctgcctggtcaaggactactt

SEQ ID NO: 531729 - DNA, 529 bp, Homo sapiens
  misc_feature: HEFZJCU01BNE9Z.8.34.D01.1.454.heavy.3.raw
ctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaaactccaggcaagggattggagtgggtgcagttgtttcatctgagggcagtgttcaatggtatgctgacgccgtgaaggccgattcaccatctccagagacaactccaggaacacaatgtatttggacctgaacagcctaagtcctgaggacacgggtgtatactactggtacgaagggaggggggaaccaggcgggagttccgaagtactcctttgacgtcgtcggggtaccg

SEQ ID NO: 531730 - DNA, 495 bp, Homo sapiens
  misc_feature: HEFZJCU01D6256.22.86.H09.1.454.heavy.3.raw
  modified_base (309)..(309): a, c, t, g, unknown or other
acatacgcgtcacgaccggtgctcgatttagtgctatagacttggggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattatatggtatgatggaagtaataaagactatgtggactccgtgaagggccgattcaccatctccagagacaactccaagaacactctgtttctccaatgaacagcctgagaggcgaggacacggcagtgtattactgtagcgagagatcgacatgactacggg

SEQ ID NO: 531731 - DNA, 552 bp, Homo sapiens
  misc_feature: HEFZJCU01DTSWQ.12.40.D07.1.454.heavy.3.raw
atacgacgtacacgaccggtgctcgatttagtgatagagcgtaacaacagagggctcaccatggagtttgggctgagctgggttttcctcgttgctctttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgtaggggccgattcaccatctccagagacaattacaagaacaccctttatctgcaaatagacagcctgagaccagacgacacggctgtctattattgcgcgagagagacacacgaacctactggccaatactatgggggcttgttcgttggggccgagggggacccgtcggtctatcgtctccccacgcccgtcccaccgaacgggcccacgtccggtcctttcccccgttggccgcccgtcg

SEQ ID NO: 531732 - DNA, 490 bp, Homo sapiens
  misc_feature: HEFZJCU01A75HS.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgagggcacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaggactacttccgtatctctcg

SEQ ID NO: 531733 - DNA, 539 bp, Homo sapiens
  misc_feature: HEFZJCU01BB2LO.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatcccagactccggggagggccgattcaccgtctccagagacaattccaagaacagggtgtttctccaagtgattgatctgagaagtgaggacacggcttgtttattactgtgcggtcggtggctgacccgctcttgactacgtggggggcccggggagccccggtcactcgtactccc

SEQ ID NO: 531734 - DNA, 350 bp, Homo sapiens
  misc_feature: HEFZJCU01CPZSN.4.28.C06.1.454.heavy.3.raw
  modified_base (151)..(151): a, c, t, g, unknown or other
  modified_base (262)..(262): a, c, t, g, unknown or other
agcactgtagcacgaccggtgctcgatttagagctcacgtattgggtttgggggccccagccctgggattcccagctgtttctgcttgctgatcaggactgcacacagagaacttcaccatggaatttgggctgagccgtgggttttcctnttaggctattttaaaaggtcgtccagtgtgaggtgcctcctggtaggagtccggggagcctagttcaaggcctgggacgtccctaagctctcctgtacggtcaggcccttnacggattcgaccttcagttagttactggctactagttgggtccgccaggcttccagggaagggctggtccgtgggtctcgtcgtatga

SEQ ID NO: 531735 - DNA, 525 bp, Homo sapiens
  misc_feature: HEFZJCU01ESA9V.13.76.G10.1.454.heavy.3.raw
tcacgtactacacgaccggtgctcgatttagtcactcatacagggggggagaggagcccagcactgggattccgagggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcggggcccacgaacgttactacgctatggacgtcgtgggggccgaagggaccg

SEQ ID NO: 531736 - DNA, 505 bp, Homo sapiens
  misc_feature: HEFZJCU01CP6S5.47.3.A03.1.454.heavy.3.raw
  modified_base (366)..(366): a, c, t, g, unknown or other
agctcacgtacacgaccggtgctcgatttagagagcgtcacagaggagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaagggctggagtgggttggcaacataaatccagatggaagtcagaaaaaacctntagtggactctctgaagggccgattcaccatctccagagacaacgccaagaactctctgtttctgcaatggacagcctgagagtcgaagacacggctgtgtattactgtgtgtctctgcgcctcggccgcctggcttcg

SEQ ID NO: 531737 - DNA, 518 bp, Homo sapiens
  misc_feature: HEFZJCU01BRDGB.12.25.C03.1.454.heavy.3.raw
  modified_base (504)..(504): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccaccaggacacatcagcgaacacagtcaacatggagttgcggagcctgcgatctgacgacggcggccgtatattactgtgcgagagtacgtagcggctcgtcctttgactactggggcctgggaactntggtcaccgtctcc

SEQ ID NO: 531738 - DNA, 509 bp, Homo sapiens
  misc_feature: HEFZJCU01DD546.11.27.C05.1.454.heavy.3.raw
  modified_base (490)..(490): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaagggctggagtgggtctcatccattagtagtaatagtgcctacagatactacgcagactcactgaagggccactcaccatctccagagacaacgccaagaactcactgtatctgcaaatgaacagcctgaaggagccggaggacgacggctgtgtattactgtgcgagaggagctattatntcggaaccccgagtcgtcg

SEQ ID NO: 531739 - DNA, 486 bp, Homo sapiens
  misc_feature: HEFZJCU01A1PNH.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctcgctccaggagcacctccgacgagcacagcggcccgtgggctgcctggtcaaggactacttcccactactatg

SEQ ID NO: 531740 - DNA, 507 bp, Homo sapiens
  misc_feature: HEFZJCU01DMOZB.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacccgtaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgacgcctacggcagcggcctttgacttcgtc

SEQ ID NO: 531741 - DNA, 522 bp, Homo sapiens
  misc_feature: HEFZJCU01EMLCG.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggtctacttcgatctctgggccgt

SEQ ID NO: 531742 - DNA, 533 bp, Homo sapiens
  misc_feature: HEFZJCU01CPCBD.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaatgaataacctgagagcgaggacacggccatgtattactgtgtggggctagtttacttgaccccgtgggggcccggggaaccctggtcaccgtctccccaccctccaaccg

SEQ ID NO: 531743 - DNA, 497 bp, Homo sapiens
  misc_feature: HEFZJCU01CXEFT.52.85.H08.1.454.heavy.3.raw
  modified_base (453)..(453): a, c, t, g, unknown or other
cgcagtacgacacgaccggtgctcgatttagtatcactcagtcgcggggtatcactcagtcgcggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtnccagagggatcgctagaggtggcctccattcgttttagacttcc

SEQ ID NO: 531744 - DNA, 531 bp, Homo sapiens
  misc_feature: HEFZJCU01EA93M.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacaggccctgagaccagacgacacggctgtctattattgcgcgagagagacacacgaacctaactggccaatactatgggggcttgttctggggtccaggggaccctggtcatcgtctccccagcctccaccaaggcccatcggtccttcccctggccgcctcg

SEQ ID NO: 531745 - DNA, 521 bp, Homo sapiens
  misc_feature: HEFZJCU01DACH1.48.35.D02.1.454.heavy.3.raw
agtatacatacacgaccggtgctcgatttagcacacgatagttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactagccgtgttttattgtgcgagatccaggcgaggaggataccggattccttatatagcgactactactactttcggaatggtacg

SEQ ID NO: 531746 - DNA, 415 bp, Homo sapiens; identical to SEQ ID NO: 444794
  misc_feature: HEFZJCU01BUVTN.14.74.G08.1.454.heavy.3.raw

SEQ ID NO: 531747 - DNA, 546 bp, Homo sapiens
  misc_feature: HEFZJCU01CS59K.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttgggactctgtgaggggccgattcatcatctccagagacaacgccgacaactcactgtctctgctgatgagcagcctgagagccgaacgaccacggctatctattactggtgacgtaaactctactaacttcccggttacacttcctagtaaactacgttcgggggacccaacggggtaaccccttgggtccgtcccc

SEQ ID NO: 531748 - DNA, 513 bp, Homo sapiens
  misc_feature: HEFZJCU01ELAM4.10.34.D01.1.454.heavy.3.raw
  modified_base (484)..(484): a, c, t, g, unknown or other
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaaatctgagagtcggacgacaacggccacctattattgtgcgcgacatnactacgctcaattctggggccaggggacg

SEQ ID NO: 531749 - DNA, 437 bp, Homo sapiens
  misc_feature: HEFZJCU01D9R8C.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgcctttttacagtggagtcacctactacaaccaaagggcagccccgagaaccacaggtgtacaccctgcccccagaacgcaaagcagcgcctactatactttaaactttgacttctggggccagggatccctggtcaccgtctcctcagcctccaccaagggcccatcggtcttccccctggcgccctgctccaggagcacctccgagagcacagccggccctgggctgcctggtcaaggactacttccagacgtatca

SEQ ID NO: 531750 - DNA, 534 bp, Homo sapiens
  misc_feature: HEFZJCU01B35BE.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactacgtggggcctaggggaaactctgggtccaccggtcctccgcagccctccacctaacggggcccctagtccc

SEQ ID NO: 531751 - DNA, 545 bp, Homo sapiens
  misc_feature: HEFZJCU01C0U4G.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggtccgttattttacggaccaggctagttaaaaaccttcccttaaccgtaccggtcgttgggtacgtcgttcgggggaccgagggggacccgaaac

SEQ ID NO: 531752 - DNA, 516 bp, Homo sapiens
  misc_feature: HEFZJCU01D02R7.53.35.D02.1.454.heavy.3.raw
  modified_base (415)..(415): a, c, t, g, unknown or other
  modified_base (484)..(484): a, c, t, g, unknown or other
cgcgtatacacacgaccggtgctcgatttagcacacgatagttgggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccgggggggaanaacacactgtttcttcaaatggacttcctgagaactgaggacgacggccgtgtattactgcgcgagagngcatgatagtggtttccatgatgtcttttgat

SEQ ID NO: 531753 - DNA, 534 bp, Homo sapiens
  misc_feature: HEFZJCU01BQFU7.11.25.C03.1.454.heavy.3.raw
cgagagataccacgaccggtgctcgatttagtagtgtagatttgggtttgggggagaggagcccaacactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacgaacgttactacgctatggacgtcgtggggccaagggaccgacggtccg

SEQ ID NO: 531754 - DNA, 502 bp, Homo sapiens
  misc_feature: HEFZJCU01D57KY.53.14.B03.1.454.heavy.3.raw
cgcgtatacacacgaccggtgctcgatttagtgtgagtagttccgcggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatggatggatcagcgctggcaatggtgacagacactattcacagaagttccagggcagagtcaccatcaccagggacacatccgcgaagcacagcctacatggaactgagcagcctgagatctgaagacacgggtgtagtattactgtgcgagaaggggaagtggggacttaagttgtaagatgcgccaggtcggccggcccc

SEQ ID NO: 531755 - DNA, 373 bp, Homo sapiens
  misc_feature: HEFZJCU01CR2OP.51.81.H04.1.454.heavy.3.raw
cgatcgtatacacgaccggtgctcgatttagtagtgtagattcgcgggggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcaccttcacgtacccatgaaatgcactgggtccgccaggctccaggcgaaggggctggagtgggtggctaagttagtatcctatagattagggaacgcaataagccaactaccg

SEQ ID NO: 531756 - DNA, 533 bp, Homo sapiens
  misc_feature: HEFZJCU01D09SE.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctaggtcaccgtctcctcagcctccaccaagggcccatcggtccttcccctggccgccctcgctccgaggagcacctccgacgacg

SEQ ID NO: 531757 - DNA, 525 bp, Homo sapiens
  misc_feature: HEFZJCU01ELSSB.40.37.D04.1.454.heavy.3.raw
tctagcgactcacgaccggtgctcgatttagtagcatactgttgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcgaggaagtggggagctggtaggcctcaatacgtgggggacc

SEQ ID NO: 531758 - DNA, 520 bp, Homo sapiens
  misc_feature: HEFZJCU01EEFNX.51.23.C01.1.454.heavy.3.raw
cgatcgtatacacgaccggtgctcgatttagtacacgtgattagggattggggacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcaccccctatatttgatgtagcagactctgcacagaagttccagggcagaataacaattacggcggacaaatccacgaccacagcctacatggagctgagcagcctgagatctgaggacgaccggcccttttattaactgttgcgagtactttaccggttggggggtcacgggcggagtatatccgccataacttactttgta

SEQ ID NO: 531759 - DNA, 502 bp, Homo sapiens
  misc_feature: HEFZJCU01BXQ0H.12.38.D05.1.454.heavy.3.raw
  modified_base (438)..(438): a, c, t, g, unknown or other
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagccgtggtcaccggtctcctcagcctccaccaagggcccatcggtcttcccctggcgccctgctccnggagcacctccgagagcacagcggccctgggctgcctggtcaaggactacttcctacgtcgtat

SEQ ID NO: 531760 - DNA, 487 bp, Homo sapiens
  misc_feature: HEFZJCU01BPQDY.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctccagagacagtgccaagaactcactgtatctgcaaatgaacagccttagagacgacgacgacggctgtgtattactgtgcgagagatccg

SEQ ID NO: 531761 - DNA, 522 bp, Homo sapiens
  misc_feature: HEFZJCU01BV5SX.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgacttactgggccagggaactctggtcaccgtctccgcacgcctaccaccaacgggcccagttcc

SEQ ID NO: 531762 - DNA, 496 bp, Homo sapiens
  misc_feature: HEFZJCU01BV5QU.48.22.B11.1.454.heavy.3.raw
agtatacatacacgaccggtgctcgatttagacgacagctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccgaaggacaatggtcaccgtct

SEQ ID NO: 531763 - DNA, 515 bp, Homo sapiens
  misc_feature: HEFZJCU01D8W43.9.64.F09.1.454.heavy.3.raw
tgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccaggggaagggcctggagtgggtggccaacataaaggaagatggaagtgagaagtcctatgtggactctgtgaagggccgattcatcatctccagagacaacgccgagaacctccctgtatctgcaaatgaacagcctgagagtcgaggacacggctatgtattattgtgtgagagaataaaagtggggccagggaaccctggtcaccgtctcctcacg

SEQ ID NO: 531764 - DNA, 515 bp, Homo sapiens
  misc_feature: HEFZJCU01CBWPQ.13.55.E11.1.454.heavy.3.raw
tcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatactatttactgtgctaggagagtaagttgcagtcctacgta

SEQ ID NO: 531765 - DNA, 393 bp, Homo sapiens
  misc_feature: HEFZJCU01CP0CO.49.29.C07.1.454.heavy.3.raw
  modified_base (362)..(362): a, c, t, g, unknown or other
agtcgagagacacgaccggtgctcgatttagagtgctacgaagggaaaggggggtgatcatcactgaacacagaggactcaccatggagtttgggctgagcgtgggtttccgtcgttagctcttttaagaggtgtccagtgtcaggtgcttctggtggactctgggggaggcgtggtccggcctgggaggtccctgagactctcctgtgcagcctctcagttcacccttcagtgtctaatactatgcactgggtccgcaggctccaggcaaggggctggagttgggtggcacttatatcaaatgatggaacgaattcaacactacgcaggctccgtgaagggccgattcaccatctccaagngacaattccaagaacactactgtctctgcaa

SEQ ID NO: 531766 - DNA, 489 bp, Homo sapiens
  misc_feature: HEFZJCU01CPX4F.49.82.H05.1.454.heavy.3.raw
agtcgagagacacgaccggtgctcgatttagtcgagctctctcgcggggagctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaaagaactcactgtatctccaaatgaacagcctgagagtcgaggacacggctgtctattactgtgcgagagatcccaac

SEQ ID NO: 531767 - DNA, 499 bp, Homo sapiens
  misc_feature: HEFZJCU01C91SS.53.26.C04.1.454.heavy.3.raw
cgcgtatacacacgaccggtgctcgatttagtctagcgactttgggtttggggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacaggggcccagtcagaacagcctacaatggagctgaacagactgacatctgacgacacggccgtttattattgtgtgagagacggacccgatggacctc

SEQ ID NO: 531768 - DNA, 544 bp, Homo sapiens
  misc_feature: HEFZJCU01BMU2U.51.15.B04.1.454.heavy.3.raw
cgatcgtatacacgaccggtgctcgatttagacagtatatatccgcgggattttagaaggtgtccaatgtgaggtgcacctggtggagtctgggggaggcttggtccagccgggggggtccctgagactctcctgtagagcctctggattcacctttagtaacttctggatgagctgggtccgccaggctccagggaaggggctgggagtgggtggccaacataaacaaagatggaggtgagaagtactatgtggactctgtgaagggccgattcaccgtctccagagacaacgccaagaactcactgtatctgcaaatgaacagcctgagaaccagggacacggccctgtattactgtgcgagacacgggtcaaaacaactttggttcgggaaagactcctggggccaggggaccctggtcaccgtctcctcagcctccaccaagggcccatcggtcttcccctggcaccctcctccaagagcacctctgggggcacgagcggccctgggctgcctggtcaaggactacttcctcgtagcact

SEQ ID NO: 531769 - DNA, 526 bp, Homo sapiens
  misc_feature: HEFZJCU01DTQJJ.10.59.F04.1.454.heavy.3.raw
  modified_base (452)..(452): a, c, t, g, unknown or other
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccgactacaacccgtccctcaggagtcgagtcaccatctcactagacacgtccaggaatcacctctccctgacggtgacctctgtgaccgccgcggacacggccgtggtattattgtgcgagagaccccgntagaagattcctacatgtactttggaccactggggaccaggggacgcccgtggtccacccgtcctcctcctacg

SEQ ID NO: 531770 - DNA, 394 bp, Homo sapiens
  misc_feature: HEFZJCU01C7QVP.16.72.G06.1.454.heavy.3.raw
tgtactactccacgaccggtgctcgatttagctacgactgcaagggaaagggctggagtgggtctcatctattagtagtagtgatagtgccacatactacgcagactccgtgaagggccggttcaccatctccagagatagatccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaacgagcacctctggggcacagcggccctgggctgcctggttcaaggactacttccgagtagtaca

SEQ ID NO: 531771 - DNA, 497 bp, Homo sapiens
  misc_feature: HEFZJCU01EKYDQ.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctagttattactgtgcgagagggaagtgggatattgtggcagctccaggtgcccagccggccccttacg

SEQ ID NO: 531772 - DNA, 496 bp, Homo sapiens
  misc_feature: HEFZJCU01APLQ8.49.21.B10.1.454.heavy.3.raw
  modified_base (494)..(494): a, c, t, g, unknown or other
agtcgagagacacgaccggtgctcgatttagtgtcgtcgcaagggggctctgggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtgcaggtatatcagctgatgggaccaaatatactacgcaaactccgtgaagggccgattcaccatatcaagagacacttccgatgacacaatctatctgcaaatgaacagcctgaaagttgacgacacgggtctttttactgtgcgcctggaagcagtggctggccacatnat

SEQ ID NO: 531773 - DNA, 488 bp, Homo sapiens
  misc_feature: HEFZJCU01EDXO4.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgaccgacgggccgttatattttcgtgttggcggaggg

SEQ ID NO: 531774 - DNA, 500 bp, Homo sapiens
  misc_feature: HEFZJCU01ASXL2.26.23.C01.1.454.heavy.3.raw
agactatactcacgaccggtgctcgatttagtacacgtgattagggattgggaggcgtggtccagcctggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgacccactggggccagggaaccctggtcaccgtctcctcagcctccaccaaggcccatcggtcttcccctggccgccctgctccaggagcacctccgagagcacagcggccctgggctgcctggtcaaggctacttccagtatagtct

SEQ ID NO: 531775 - DNA, 529 bp, Homo sapiens
  misc_feature: HEFZJCU01EKXXF.52.35.D02.1.454.heavy.3.raw
cgcagtacgacacgaccggtgctcgatttagcacacgatagttgggtttgggggggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccaggggaaggggctggagtgggtctcaagtctttatgtcggtggtaccacatattatgctgactccgtgaagggccgattcaccatctccagagacgagtccaggaaccagccttgtttcttcaaatggacagtctgagacctgacgacacgggctgtctattactgtgcgagagaacccaggggggcgggagcagccccgtaacttcgtggggccagggaaccc

SEQ ID NO: 531776 - DNA, 518 bp, Homo sapiens; identical to SEQ ID NO: 453293
  misc_feature: HEFZJCU01BHLN3.9.34.D01.1.454.heavy.3.raw

SEQ ID NO: 531777 - DNA, 505 bp, Homo sapiens
  misc_feature: HEFZJCU01E0MJ3.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagtctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctaggtctgggatctagttatagtgactcgtcgttcgtggggaccg

SEQ ID NO: 531778 - DNA, 517 bp, Homo sapiens
  misc_feature: HEFZJCU01AWJCC.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccagggaagggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccgaagggaccg

SEQ ID NO: 531779 - DNA, 519 bp, Homo sapiens; identical to SEQ ID NO: 444867
  misc_feature: HEFZJCU01CFQEW.9.34.D01.1.454.heavy.3.raw

SEQ ID NO: 531780 - DNA, 488 bp, Homo sapiens
  misc_feature: HEFZJCU01AHQGF.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatgggggtggatcaaccctaccagaggtggcacaaagtatcgacagaactttcagggcagggtcaccatgacctgggacgcgtccatcagcacagtctacatggatctgagcggactgacctctgacgacgaaccgccatgtattactgtggagagacgtgtggctacgcgggctgacac

SEQ ID NO: 531781 - DNA, 494 bp, Homo sapiens
  misc_feature: HEFZJCU01ED3JM.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagttattacgcagactccctgaggggccgattcaccatctccagagacaattcccagaacacggtctaatctgcacctgaccagcctgagaactgacgacacgtctctctactactgtgcgagagagttggacgagt

SEQ ID NO: 531782 - DNA, 510 bp, Homo sapiens
  misc_feature: HEFZJCU01A6104.52.82.H05.1.454.heavy.3.raw
cgcagtacgacacgaccggtgctcgatttagtcgagctctctcgcgggggggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtctgggggaggcgtggtccagtctgggaggtccctggagactctcctgtgcagcctctggattcaccttcagtacctatagtatacactgggtccgccaggctcctggcaagggactggagtgggtggcatctatatcaaatgatggaaacaataaccattctacagactccgtaaagggccgattcaccatctccagagacaattccaagaacacggtgtctctacaaatgaacagtttgagacttgaggacacggctgtatattactgtgcgcgagggaatcgattatagctagccctacgaagaccatcg

SEQ ID NO: 531783 - DNA, 509 bp, Homo sapiens
  misc_feature: HEFZJCU01D5DOM.13.67.G01.1.454.heavy.3.raw
tcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgacaaaagatacccaaccccttacgtactttttggt

SEQ ID NO: 531784 - DNA, 541 bp, Homo sapiens
  misc_feature: HEFZJCU01BMX0C.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatggtaggaaaaagtaatggctgtgtttattgggggccaggggagccctggtctaccgg

SEQ ID NO: 531785 - DNA, 501 bp, Homo sapiens
  misc_feature: HEFZJCU01ECSIE.17.10.A10.1.454.heavy.3.raw
  modified_base (462)..(462): a, c, t, g, unknown or other
cgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcacgaagatgaagggcagagtcacgattaccacggacacccccacgaacacagtctacatgcaactgacgagcctgagagctgacgacacggcgtactattactgtgcgagaatgttttctgtanatcgtacaatttgataggtctctatggactgacttcgtc

SEQ ID NO: 531786 - DNA, 520 bp, Homo sapiens
  misc_feature: HEFZJCU01EKNSX.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcagtcgtctccccagcctccaccaaggcccatcgtctccccctggcg

SEQ ID NO: 531787 - DNA, 496 bp, Homo sapiens
  misc_feature: HEFZJCU01D78JG.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggcctgtgtattactgtgggagagatggaggtcgatattgtagt

SEQ ID NO: 531788 - DNA, 500 bp, Homo sapiens
  misc_feature: HEFZJCU01CLJR2.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgacggacacggctggtgttattacgtgttgggagagatgggaggtcgattattgta

SEQ ID NO: 531789 - DNA, 362 bp, Homo sapiens
  misc_feature: HEFZJCU01CRSPS.16.17.B06.1.454.heavy.3.raw
tgtactactccacgaccggtgctcgatttagtcgatagtgaaggggggggttccaactacaatccgtccctcaagagtcgactcaccctttcggtggacaagtccaagaaccacttctccctgcggttatgttctgtgaccgccgcggacacggccgtgtattactgtgcaaaaacttacgacttttggagtggacctgttccggacatgttcgacccctggggccaaggaaccctggtcaccgtctctccagcttccaccaagggcccatccgtcttccccctggcgccctgctccaggagcacctccgagagcacagccgccctgggctgcctggtcaaggactacttccgagtagtaca

SEQ ID NO: 531790 - DNA, 519 bp, Homo sapiens
  misc_feature: HEFZJCU01D6YWK.7.28.C06.1.454.heavy.3.raw
  modified_base (414)..(414): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgntgagcagcctgagagccgacgacacggctatctattactgtgcgaaactctcattccgttcatctgtaatactgggggcctacggggaaccctgggtccgtcccg

SEQ ID NO: 531791 - DNA, 518 bp, Homo sapiens
  misc_feature: HEFZJCU01B1HAN.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggcaagggaccacggtcatcgtctcctcagcctccaccaaggcccactcgtcttcccctggcaccctcctccaagacgcacctctgggggcac

SEQ ID NO: 531792 - DNA, 493 bp, Homo sapiens
  misc_feature: HEFZJCU01DY86J.51.67.G01.1.454.heavy.3.raw
cgatcgtatacacgaccggtgctcgatttagagtatacatattgggtttgggctcaactctcttgtccaccttgctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtggggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcacggagacaacggtcgaccccggtcgctcggtgcggaggtctggggccaagggaccacggtcatcgtctcctc

SEQ ID NO: 531793 - DNA, 509 bp, Homo sapiens
  misc_feature: HEFZJCU01CI3G1.3.85.H08.1.454.heavy.3.raw
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaagggccgcttcaccatctccagagacaattccaagaacacgactgcatctgcaaatgaacagcctgagagccgaggacacggccctttacttactgtgcgaaaccaatcacgtataactggaactacgtaa

SEQ ID NO: 531794 - DNA, 506 bp, Homo sapiens
  misc_feature: HEFZJCU01AWNNE.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatataggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctagacgacacggccgtctattactgtgcgagaattgttttctgtcatcgtacaatttgataggcttctatggactggacttcgtc

SEQ ID NO: 531795 - DNA, 504 bp, Homo sapiens
  misc_feature: HEFZJCU01A1I97.49.82.H05.1.454.heavy.3.raw
agtcgagagacacgaccggtgctcgatttagtcgagctctctcgcgggggaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaaggggactggagtggggtttcatacattagtcggagagtcaacaccgtattctacacagactctgtgaggggccgattcaccatctccagagacaacgccagaactcactgtatctccaatgaacagcctgagagtcgaggacacggctgtctattactgtgcgaggagatacccaacacgcggctcggtactttgacttac

SEQ ID NO: 531796 - DNA, 500 bp, Homo sapiens
  misc_feature: HEFZJCU01D3PQH.51.46.E02.1.454.heavy.3.raw
cgatcgtatacacgaccggtgctcgatttagactcatctacagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtcggggggaggcgtggtccagcctgggaggtccctgagactctcctgtgcagcctctaaattcagtttcagtagatttggcgtgcactgggtccgccaggctccaggcaaggggctggagtgggtggcagttatatcatatgatggaaagaataaatactatggagactccgtgaagggccgattcaccatctctagagacaatctcaaggagacagtgcatctgacaaatgaacagcctagagaggtgacgacacggctgtgtattactgtcacctcgagagcagcaattggagagtta

SEQ ID NO: 531797 - DNA, 379 bp, Homo sapiens; identical to SEQ ID NO: 444450
  misc_feature: HEFZJCU01BYHP2.47.77.G11.1.454.heavy.3.raw

SEQ ID NO: 531798 - DNA, 522 bp, Homo sapiens
  misc_feature: HEFZJCU01AOCNC.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctggagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatattattactgtgacgaaagccaccgggcagtttagtccaacccgataccttaacgtttcgaactacgtgggg

SEQ ID NO: 531799 - DNA, 515 bp, Homo sapiens
  misc_feature: HEFZJCU01DIKR0.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggaccacggccatatattactgtgacgaaagacacagccgcagtttgggggagtcatcgtcctt

SEQ ID NO: 531800 - DNA, 505 bp, Homo sapiens; identical to SEQ ID NO: 472200
  misc_feature: HEFZJCU01DDP62.17.25.C03.1.454.heavy.3.raw

SEQ ID NO: 531801 - DNA, 528 bp, Homo sapiens
  misc_feature: HEFZJCU01B50I7.17.33.C11.1.454.heavy.3.raw
cgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgacttaacgtggggccgaggggaactctgggtcaccgtctccgtcagcctccaccaacgggccccagtcc

SEQ ID NO: 531802 - DNA, 510 bp, Homo sapiens
  misc_feature: HEFZJCU01DIWYO.51.40.D07.1.454.heavy.3.raw
cgatcgtatacacgaccggtgctcgatttagtgatagagcgtaacaacagagggggctctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattccaccatctccagagacaattccaagaacacactgtttctgcacatagaaaagcctgagagctgaggacacggctgtttattactgtgcgtaacttaatcaacggaggactaaaccc

SEQ ID NO: 531803 - DNA, 538 bp, Homo sapiens
  misc_feature: HEFZJCU01A5TRM.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccggggaggcttagttcagcctgggaagtccctgagactctcctgtgcagcctctggattcaccttcagcaattactggctgcactgggtccgccaagctccagggaaggggctggtgtgggtctcacatattaatctcgatgggataatttagcctacgcggactccgtcaagggccgattcaccgtctccagagacaacaccaagaacacactatatctgcagattgacagtctgagacccgaggacacggctgtgtattacgtgtgacaaggcaggttcgtaggaaacagttatgggtttggggggagtttggggtttttttttcgttacgttacgggt

SEQ ID NO: 531804 - DNA, 534 bp, Homo sapiens
  misc_feature: HEFZJCU01BHCP3.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattgggtctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctagagagccgaggacacggctgtatattattgtgtgagattagcgcactactttgactactgggggccaggggaaccctgggtcaccggt

SEQ ID NO: 531805 - DNA, 532 bp, Homo sapiens
  misc_feature: HEFZJCU01ESHZT.49.12.B01.1.454.heavy.3.raw
  modified_base (487)..(487): a, c, t, g, unknown or other
agtcgagagacacgaccggtgctcgatttagtagtgtagattccgcgggtctgagagaggagcccagccctgggattttcaggtgttttcatgtggtgatcaggactgaacagagagaactcaccatggagtctgggctgacgtggctttttcttgtggctattttaaaaggtgtccagtgtgacgtgcaactggtggagtctgggggaggcttggtacagccgggggggtccctgagactctcctgtacagcctctggcttcacctttagagtctatgacatgagttgggtccgccaggctccggggaagggctggagtgggtctcaacgatcagtgaaagtggaagtaccacaaagtacgccgactccgtgaagggccggtgcaccatctccagagacaattcgaaggacactttatatctgcaactcaacagactgacaaccgcggacacggccgtctattactgtgtgaaagaagacggaccncgtggacgaggagccagaggagaatccactactttgacccacgtc

SEQ ID NO: 531806 - DNA, 527 bp, Homo sapiens
  misc_feature: HEFZJCU01EB41A.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacgggccgtttattactgtgcgagagattcgagtggttcggggacctcaccctggttctacttcgatctcgtggggccgtc

SEQ ID NO: 531807 - DNA, 495 bp, Homo sapiens
  misc_feature: HEFZJCU01EOR7L.10.71.G05.1.454.heavy.3.raw
  modified_base (467)..(467): a, c, t, g, unknown or other
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactataggagactccttcaagggccgattcaccatctccagagacaattccaagaacatggtgtatctgcaaatgaccagcctgagagccgaggacacgggtntttatactgtgggaagaatcctagtggc

SEQ ID NO: 531808 - DNA, 500 bp, Homo sapiens
  misc_feature: HEFZJCU01C28AR.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaaggggccgattcaccatctccagagacaattccaagaacacgcagtatctgcaaatgaacagcctgagagctgaggacacggctgtgtattactgtggggagagagtgggaaggtcgatattggtta

SEQ ID NO: 531809 - DNA, 538 bp, Homo sapiens
  misc_feature: HEFZJCU01EBTNA.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtgggggcccacgaacgtttaacctacgtctagtggacgtctgggggccaaggggaccctacc

SEQ ID NO: 531810 - DNA, 499 bp, Homo sapiens
  misc_feature: HEFZJCU01BA2QN.13.85.H08.1.454.heavy.3.raw
  modified_base (475)..(475): a, c, t, g, unknown or other
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggccctgggcaaggtcttgagtggatgggactaatcactcccaatggtgatgggactgcctacgcacagaagtttcagggcagagtcaccatgaccagggacacgtccacgagaacagactatttggagttgagcagcctgagtatctgacgaacacgggccgtttattactgtgcgcgagataatagtcanaacgtggaacggtcgttttggggt

SEQ ID NO: 531811 - DNA, 534 bp, Homo sapiens
  misc_feature: HEFZJCU01A2K1E.48.35.D02.1.454.heavy.3.raw
agtatacatacacgaccggtgctcgatttagcacacgatagttgggtttggggggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatcctattatacagggagcaccgtactacaacccgtcccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgaccccgtggggccgagggactaccgttcgggtccgacccggtccgttccctccgacgccttt

SEQ ID NO: 531812 - DNA, 495 bp, Homo sapiens
  misc_feature: HEFZJCU01AMH45.14.25.C03.1.454.heavy.3.raw
  modified_base (434)..(434): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcaggtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacngcctgagagctgaggacacggctgtgtattactgtgggagagatgggaggtcgatattgta

SEQ ID NO: 531813 - DNA, 414 bp, Homo sapiens; identical to SEQ ID NO: 445248
  misc_feature: HEFZJCU01D758P.14.74.G08.1.454.heavy.3.raw

SEQ ID NO: 531814 - DNA, 522 bp, Homo sapiens
  misc_feature: HEFZJCU01BRXIO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaaccaccctttatctgcaaatagacagcctgagaccagacgacacggctgtctattattgcgcgagagagacacacgaacctactggccaatactatgggggcttgttctggggccaggggaccctggcatcgtctccccagcctccaccaagggcccatcggtcttcccctggccg

SEQ ID NO: 531815 - DNA, 507 bp, Homo sapiens
  misc_feature: HEFZJCU01C38XM.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccagggcccatcggtcttcccctggcgccctgctccacggagcacctccgagagcacagcgccctgggctgcctggtcaaggactacttccgagtgcgtct

SEQ ID NO: 531816 - DNA, 495 bp, Homo sapiens
  misc_feature: HEFZJCU01EIHMY.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaagagcacctctgggggcacagcggccctgggctgcctggtcaaggactacttccgatgtaca

SEQ ID NO: 531817 - DNA, 379 bp, Homo sapiens; identical to SEQ ID NO: 444450
  misc_feature: HEFZJCU01CFYBL.47.77.G11.1.454.heavy.3.raw

SEQ ID NO: 531818 - DNA, 400 bp, Homo sapiens; identical to SEQ ID NO: 444452
  misc_feature: HEFZJCU01B6HPB.47.24.C02.1.454.heavy.3.raw

SEQ ID NO: 531819 - DNA, 503 bp, Homo sapiens
  misc_feature: HEFZJCU01BVWW0.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttccccctggccgcctcgctcc

SEQ ID NO: 531820 - DNA, 500 bp, Homo sapiens
  misc_feature: HEFZJCU01DLW9O.11.41.D08.1.454.heavy.3.raw
cgagagataccacgaccggtgctcgatttagtcacgcgagaaagggaaagggtctccgaagccttcggagaccctgtccctcacctgcactgtctctggtgactccatcagtaggtactattggagctggatccggcagcccccagggaagggactggagtggattgggtggatgtattacagtgggagcaccaactacaacccctccctcaagagtcgagtcaccatatcagtagacatgtccaagaaccagtgctccctgaagctgagctctgtgaccgctgcggacacggccgtgtattactgcgcgaaagggggatatagtggctacaatcggccctactacggtatggacgtctggggccaagggaccacggtcaccgtctcctcagcctccaccaagggcccatcggtcttcccctggcaccctcctccaagagcacctctgggggcacagcggccctggggctgcctggtcaggactacttccgtatctctcg

SEQ ID NO: 531821 - DNA, 504 bp, Homo sapiens
  misc_feature: HEFZJCU01B3P46.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctggtgagcgccgcagacacggccgtgtattactgtgcgagactggccgcaacagactacggtggcaactcctagtgcttttgatatcgtgggtccaaggggac

SEQ ID NO: 531822 - DNA, 504 bp, Homo sapiens
  misc_feature: HEFZJCU01ETYQN.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctgacgggcctgacatctgaagacacggctttatatttactgtgcgcgagatggctggcacagagggcacaactggctcgacccc

SEQ ID NO: 531823 - DNA, 532 bp, Homo sapiens
  misc_feature: HEFZJCU01EDD4S.13.10.A10.1.454.heavy.3.raw
tcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagttttgggctgaggtggtttttccttggtgctattttaaaaggtgtccattgtgaagtgcccctggtacaatctgggggaggcttggtcaagccgggggagtccctgagactctcctgtgaagcctcaacattcacttttgctcgtgcctgggtgacctgggtccgccaggctccagggaaggggctgggagtggattggccatattaaggacagacctaatggcgcgacagcacactaccttgaatccgtcaaagacagattcatcatctcgagaggtgattccgacaacacggtgtctctccatatgagcagcctgaaaatctaggacacaggcctatatta

SEQ ID NO: 531824 - DNA, 473 bp, Homo sapiens
  misc_feature: HEFZJCU01EDQLH.11.63.F08.1.454.heavy.3.raw
cgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcaggggtcatcatgaccagggacacgtccatcagcacagcctacatggagctgagcaggctgacatctgacgacacggccgtgtattactgtgcgagagataaaggggattgt

SEQ ID NO: 531825 - DNA, 534 bp, Homo sapiens
  misc_feature: HEFZJCU01CH4MK.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactacgtggggccagggaaccctggtcaccgtctcctcagccctccaccaaggg

SEQ ID NO: 531826 - DNA, 517 bp, Homo sapiens
  misc_feature: HEFZJCU01DO35K.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccgacgacgtccggtggaacgccctacgggcacggcggccttttgacctttcgtc

SEQ ID NO: 531827 - DNA, 476 bp, Homo sapiens; identical to SEQ ID NO: 457403
  misc_feature: HEFZJCU01A8UD8.48.56.F01.1.454.heavy.3.raw

SEQ ID NO: 531828 - DNA, 524 bp, Homo sapiens
  misc_feature: HEFZJCU01ADNX8.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccattcaccatctccagagacaattccaagaacacgctgtttcttcaaatgaacagcctgagagccgatgacacggccgtgtattactgtgcgagagagtggggcccacggaacgttactacgctatcggacgtcgtggggccaacgggtaccg

SEQ ID NO: 531829 - DNA, 388 bp, Homo sapiens
  misc_feature: HEFZJCU01C8559.51.49.E05.1.454.heavy.3.raw
cgatcgtatacacgaccggtgctcgatttagagcgactagcaacacacaaagggggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcagggaccacggtcgccgtctcttcagcctccaccaagggcccatcggtcttcccctggcaccctcctccaagagcacctctgggggcacagcggccctgggctgcctggtcaaggactacttcctcgtagcact

SEQ ID NO: 531830 - DNA, 520 bp, Homo sapiens; identical to SEQ ID NO: 472522
  misc_feature: HEFZJCU01C9V9S.10.9.A09.1.454.heavy.3.raw

SEQ ID NO: 531831 - DNA, 516 bp, Homo sapiens
  misc_feature: HEFZJCU01AFHYO.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctagcgatctgacgacgcggccgtatattactgtgcgagagtacgtagcggctcgttcctttgacttacgtgggcctgggactcgtggtccacgtct

SEQ ID NO: 531832 - DNA, 515 bp, Homo sapiens
  misc_feature: HEFZJCU01C8AT1.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactactgggggccagggaaccctggtaccg

SEQ ID NO: 531833 - DNA, 524 bp, Homo sapiens
  misc_feature: HEFZJCU01EZG9W.48.35.D02.1.454.heavy.3.raw
agtatacatacacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggacctggaatggattgggagtatctattatacagggagcacctactacaacccgtccctcaagagtcgagtcaccatctccgcagacacgtccaagaaccagttctccctgaggctgagctctgtgacccgccgcagacacggctgtctattactgtgcgagaggtgggtcgtggcagtggctggtacgtggtctctcagtggttccgaccccgtggggccagggactaccgtggtctacccg

SEQ ID NO: 531834 - DNA, 498 bp, Homo sapiens
  misc_feature: HEFZJCU01BJVDL.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccaggcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagagggtgacgacacgggtgtttattactgtgcgcgggataggaggctcatcgtggatacaa

SEQ ID NO: 531835 - DNA, 513 bp, Homo sapiens
  misc_feature: HEFZJCU01DSS4M.48.81.H04.1.454.heavy.3.raw
  modified_base (499)..(499): a, c, t, g, unknown or other
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttgacctgagcggcctgagaccgtgacggacacggccatttacctactgtgcggcggggaggtggacggagcgttcggttttacggagttatnatctactactttgt

SEQ ID NO: 531836 - DNA, 510 bp, Homo sapiens
  misc_feature: HEFZJCU01BZMCG.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacgcatccacgagcacagcctaccatggaactgaggagcctgagatctgacgacacggccgtatatttctgcgcgagagacgtaaaagtagacgtggtacttcggggggtacgacgatgacacc

SEQ ID NO: 531837 - DNA, 385 bp, Homo sapiens
  misc_feature: HEFZJCU01B737U.27.46.E02.1.454.heavy.3.raw
agcgtcgtctcacgaccggtgctcgatttagactcatctacagggaaagggactggaatttgtttcagctgttagtcctaatgggggtaacacatattacggagactccgtgaagggcagattcaccatctccagagacaattccaacaatacgttgtatcttcaaatgagcagtctgagagctgaggacacggctacattttattgtgtgaaagtccaaggccggaatactactttgactactggggccagggaaccctggtcaccgtctcctcagcttccaccaagggcccatccgtcttcccctggcgccctgctccaggagcacctccgagagcacagccgccctgggctgcctggtcaaggactacttccagacgacgct

SEQ ID NO: 531838 - DNA, 499 bp, Homo sapiens
  misc_feature: HEFZJCU01CDTR2.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaagggctggaatggatttcatacattagcagtagtggtgcgaccatatactacgcagactctgtgaagggccgattcatcatctccagagacaatggcaacaactcactgtatctggaatcaacagcctgagagtcgaggacacggctgtatattattgtgcgagacgccccctacggtcgtacg

SEQ ID NO: 531839 - DNA, 534 bp, Homo sapiens
  misc_feature: HEFZJCU01DQTL5.3.23.C01.1.454.heavy.3.raw
agacgcactccacgaccggtgctcgatttagtacacgtgatcaggactgaacacagaggactcaccatggactttgggctgaggtggattttccttgctgccatttttaaaaggtttccactgtgagctgcgactggtggcgtctggggaggcttggtgcagccgggtgggtccctgcgactctcctgtgcaatttctgaagccccttccaatacagtgtggatgaattgggtccgccaggctccagggaaggggctggagtggggttggccatataaaaagtaagactgctggtgagacaacagactacgctgctgcctttcagaggcagattcaccatcttcagagatgaatcacagagcactctgtttctgcaatgaacagcctggaagacgcggacacagccatgtatttattgtacatttaggacactataagttccctgggggcccaggggaacccttccgtcacccggtctccttccagcccttccacccaacgggcccatcggttccttccccctcggccgtcccg

SEQ ID NO: 531840 - DNA, 521 bp, Homo sapiens
  misc_feature: HEFZJCU01DEFHN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctctttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccgaagggacccg

SEQ ID NO: 531841 - DNA, 503 bp, Homo sapiens
  misc_feature: HEFZJCU01BEB57.14.25.C03.1.454.heavy.3.raw
cgtctagtaccacgaccggtgctcgatttagtagtgtagatttgggtttgggtgcccaagctgctggagggcacggtcaccacgctgctgagggagtagagtcctgaggactgtaggacagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctatactggatcgaccctggggccgacgggaaccctggtcaccgtctcctcagcctccaccaacgggcccatcggtccttcccctcggccaccct

SEQ ID NO: 531842 - DNA, 504 bp, Homo sapiens
  misc_feature: HEFZJCU01D7XRE.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggtctctatggtactggactttctc

SEQ ID NO: 531843 - DNA, 503 bp, Homo sapiens
  misc_feature: HEFZJCU01DFF7G.26.37.D04.1.454.heavy.3.raw
  modified_base (482)..(482): a, c, t, g, unknown or other
  modified_base (493)..(493): a, c, t, g, unknown or other
agactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctcttatatcatatgatggaagtaatgaacattacgcagactccgtgaagggccgattcaccgtctccagagacaattccaagagcacgatgttctgcaaatgaacagcctgagagttgaggacacgggtgtctatttctgtgcgcgngtccgggtggnggggtgtcga

SEQ ID NO: 531844 - DNA, 520 bp, Homo sapiens
  misc_feature: HEFZJCU01E0P8W.52.35.D02.1.454.heavy.3.raw
cgcagtacgacacgaccggtgctcgatttagcacacgatagttgggtttggggtctctgagagaggaggccagccctgggattttcaggtgttttcatttggtgatcaggactgaacagagagaactcaccatggagtttgggctgagctggctctttcttgtggctattttaaaaggtgtccagtgtgacgtacagctggtggagtcggggggagccttccaacacccggggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagctgagagtcgaggacgacggccggtttattactgtgcgaaagatcgaggtcgcgatgtacacgtttttagggagtgg

SEQ ID NO: 531845 - DNA, 522 bp, Homo sapiens
  misc_feature: HEFZJCU01BN1K5.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactaacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctcgcgagccgaggacacggccgtatattactgtgcgagaacgtaaccgtcgcctggttattacc

SEQ ID NO: 531846 - DNA, 514 bp, Homo sapiens
  misc_feature: HEFZJCU01EOV16.10.71.G05.1.454.heavy.3.raw
catagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactcctttcaaggggccgattcaccatctccagagacaattccaagaacatggtgtatctgcaaatgaccagcctgagagccggaggactacggggttgttttattaactggtgggaaggtaaatccgtagtgggcatctaccg

SEQ ID NO: 531847 - DNA, 539 bp, Homo sapiens
  misc_feature: HEFZJCU01AWUYV.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgcttcctttttactaccttccctttcgaccttctggggccagtcggaaccccggtccg

SEQ ID NO: 531848 - DNA, 506 bp, Homo sapiens
  misc_feature: HEFZJCU01D0XUM.51.33.C11.1.454.heavy.3.raw
cgatcgtatacacgaccggtgctcgatttagagtgagctcgttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacagcctacatggaactgaggagcctgggatctgacgacacggccgtgtattactgtgcggagagagtaggccccgaaggggggagaaggtaggttggttttccgaccgtc

SEQ ID NO: 531849 - DNA, 498 bp, Homo sapiens
  misc_feature: HEFZJCU01EZYBY.49.38.D05.1.454.heavy.3.raw
agtcgagagacacgaccggtgctcgatttagtatctgatagttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaaacacactatatcttcaaatgaacactctaggagacgtgagacacggctgtctattactgtcgcgtactgaacgtatgtcttt

SEQ ID NO: 531850 - DNA, 499 bp, Homo sapiens
  misc_feature: HEFZJCU01D6SUC.53.22.B11.1.454.heavy.3.raw
cgcgtatacacacgaccggtgctcgatttagacgacagctcagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgcaggctccaggcaagggggctggagtgggtggcagttatatcctatgatggaagcaataagcactacgcagagtccgtgaagggccgattgaccatctccagagacaactcgaagatacggttcttctacaaatgaacagcctgagagctgaggacacggctatgttttactgtgcgagagggaactcgattacagcagccctacg

SEQ ID NO: 531851 - DNA, 523 bp, Homo sapiens
  misc_feature: HEFZJCU01BC02O.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaaccgttactacgctatggacgtcgtggggccaaggggaccg

SEQ ID NO: 531852 - DNA, 505 bp, Homo sapiens
  misc_feature: HEFZJCU01C1ZAR.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagccggcctttgacttctc

SEQ ID NO: 531853 - DNA, 533 bp, Homo sapiens
  misc_feature: HEFZJCU01BE71M.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagtaatctggagctgaacagcctgtcatctgaggacacgggcttctacttctgtgcgaggagtaattactataacactgctcctttttacaccttcccttgacttctggggccatcggtaacccggtaccg

SEQ ID NO: 531854 - DNA, 476 bp, Homo sapiens; identical to SEQ ID NO: 448842
  misc_feature: HEFZJCU01EX9EA.16.10.A10.1.454.heavy.3.raw

SEQ ID NO: 531855 - DNA, 502 bp, Homo sapiens
  misc_feature: HEFZJCU01D21TU.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaggactacttccagacgtatca

SEQ ID NO: 531856 - DNA, 392 bp, Homo sapiens
  misc_feature: HEFZJCU01CZRD6.16.24.C02.1.454.heavy.3.raw
tgtactactccacgaccggtgctcgatttagtacagatcgttagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctggggcacagcggccctgggctgcctggtcaaggactacttccgagtagtaca

SEQ ID NO: 531857 - DNA, 527 bp, Homo sapiens
  misc_feature: HEFZJCU01BF0PO.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagacgcacgacgcggccccgtgggccgtcgccgtggtccaaaggtacctacttccggagtcggccgtctcc

SEQ ID NO: 531858 - DNA, 517 bp, Homo sapiens
  misc_feature: HEFZJCU01DKLX4.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaaggccgattcaccatctccagagacaacgccaagaactcactatatttgcaaatggaccgcctgagagacgaggacacggctatgtattactgtgcgagagatgaggagtggctacagttggggccgggggaaccctgggtccaaccgtcaa

SEQ ID NO: 531859 - DNA, 398 bp, Homo sapiens; identical to SEQ ID NO: 466400
  misc_feature: HEFZJCU01DO5JS.48.81.H04.1.454.heavy.3.raw

SEQ ID NO: 531860 - DNA, 482 bp, Homo sapiens
  misc_feature: HEFZJCU01DY6EV.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctcggggctgcctggtcaaggactacttccagacgtatca

SEQ ID NO: 531861 - DNA, 487 bp, Homo sapiens
  misc_feature: HEFZJCU01BF701.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctccagagacagtgccaagaactcactgtatctgacaaatgaacagccttagagacgacgacacggctgtgtattactgtgcgagagatccg

SEQ ID NO: 531862 - DNA, 527 bp, Homo sapiens
  misc_feature: HEFZJCU01DUNF5.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacaggtgggagcacctactacaacccggtccctcaaaagtcgaggcaccatatccgtagacacgtccaagaaccaattctccctgaagctgagctctgtgaccgccgcagacacggctgtctattactgtgcgaggccccgagcgcagtggtcgttttcgtatgtcctttggattagttggttgggggcccgaaaggggacgaaacgttcgggttaccacccggtc

SEQ ID NO: 531863 - DNA, 524 bp, Homo sapiens
  misc_feature: HEFZJCU01DEUMZ.15.67.G01.1.454.heavy.3.raw
  modified_base (446)..(446): a, c, t, g, unknown or other
  modified_base (493)..(493): a, c, t, g, unknown or other
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaacgttattggatgacctgggtccgccaggctccgagggaaggggctggaggtgggtcggccaacataaacaagacggaagtcagaaaaactatgtggactcgtgtgaacgggcccgattcaccatctccagagacaacgccaagaacttcaatgtattgtcaatgaacngcctgagtaggcgaaggacacggccgtagtattattgtgcgcgaagntgatgtaagctctaacaggtagcaggtggta

SEQ ID NO: 531864 - DNA, 516 bp, Homo sapiens
  misc_feature: HEFZJCU01CTJSG.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcgtgcgatctgacgacgcggccgtatattactgtggacgagagtacgtagcggctcgtcctttgactactggggccgtgggaactctggtcaccgtct

SEQ ID NO: 531865 - DNA, 367 bp, Homo sapiens
  misc_feature: HEFZJCU01EPW3E.11.20.B09.1.454.heavy.3.raw
cgagagataccacgaccggtgctcgatttagtgtagtgtgaagggactggagtggattggtcatatcgataccactggaaacaccaattacaacccctccctcaagagtcgagtcaccatatccctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggccccatcggtcttccccctggcaccctcctccaagagcacctctgggggcacagcggccctgggctgcctggtcaaggactacttccgtatctctcg

SEQ ID NO: 531866 - DNA, 502 bp, Homo sapiens
  misc_feature: HEFZJCU01EFCMV.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcgagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactattggagttgagcagcctgagatctgacgacacggccgtttattacctgtgcgcgagagtaatagtcacaactggaacggcgttttggggtggttc

SEQ ID NO: 531867 - DNA, 514 bp, Homo sapiens
  misc_feature: HEFZJCU01BZREL.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctggggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttccgtacccctgggggccgagggaacccgtggtcacccggtctccctcagcttccaccaaggcccatcggtccttcccctggccg

SEQ ID NO: 531868 - DNA, 501 bp, Homo sapiens
  misc_feature: HEFZJCU01DE2NK.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcntcatcgtacaatttgataggctctatggactggacttcgtc

SEQ ID NO: 531869 - DNA, 509 bp, Homo sapiens
  misc_feature: HEFZJCU01CRK1L.40.59.F04.1.454.heavy.3.raw
  modified_base (486)..(486): a, c, t, g, unknown or other
tctagcgactcacgaccggtgctcgatttagtacacacacttagggattggggctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcgtaaaaggggggngacaggctccgtccatcctaccg

SEQ ID NO: 531870 - DNA, 502 bp, Homo sapiens
  misc_feature: HEFZJCU01DLNAA.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgagggtgaagaagcctggggcctcagtgaaggtctcctgcaaggcttctggatacaccttcaccgcctactatatgcactgggtgcgactggcccctggacaagggcttgagtggatggggatggatcgaccctaacagcggtggcacaaagtatgcacagaagtttcagggcagggtcaccatgaccagggacacgtccatcagcacgtccatcagcacagccctacatcggacctggacggccggacctggacatctcgacgacaccgggacccgtattatttctggtcgacggtagggaa

SEQ ID NO: 531871 - DNA, 508 bp, Homo sapiens
  misc_feature: HEFZJCU01DQ3B6.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtggtgccacagactatgcaggctccgtgaggggccggattcaccatctccagagaaaatggcaagaactccttgtatcttcaaatgaacagcctgagagccggggacgacggcggtgtattactgtgtaagagagctcgatggtaacgaggggacttaagt

SEQ ID NO: 531872 - DNA, 515 bp, Homo sapiens
  misc_feature: HEFZJCU01EYGCU.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctgcgccctgctcagagcacctccgagacgcacagccggccgtgggcgtcg

SEQ ID NO: 531873 - DNA, 508 bp, Homo sapiens
  misc_feature: HEFZJCU01C65P2.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagatggaatagtggtagcataggctatgcggactctgtgaagggccgattcaccatctccagagacaacgccaacgaactaccctgtatctgcaaatgaacagcctgagagctgagacgacggccttgtattatttgtagtcaaaagatacctaaccccttaacg

SEQ ID NO: 531874 - DNA, 516 bp, Homo sapiens
  misc_feature: HEFZJCU01BZHX3.52.23.C01.1.454.heavy.3.raw
cgcagtacgacacgaccggtgctcgatttagtacacgtgattagggattgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaaataagaaatactatatagactccgtgagggccgattcaccatctccagagacaattccaagaacacgctgtatctgcacatgaacagcctgagacgccgaagacacgggtgtttattactgtgcgaacttaagttacggaggacgaacggtaatcgcccgtccgccg

SEQ ID NO: 531875 - DNA, 534 bp, Homo sapiens
  misc_feature: HEFZJCU01A7972.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacacccaaactacgcacagaagttccagggcagactcaccataaccgcggacaaattaacgaacacagttaatctggagctgaacagcctgtcatctgagacacgggcttctacttctgtgcgaggagtaattactataacactgctcctttttacaccctccttcgacttctgggccagtcggaaccccggtcaccgtcc

SEQ ID NO: 531876 - DNA, 500 bp, Homo sapiens; identical to SEQ ID NO: 446033
  misc_feature: HEFZJCU01DHFIP.11.27.C05.1.454.heavy.3.raw

SEQ ID NO: 531877 - DNA, 538 bp, Homo sapiens
  misc_feature: HEFZJCU01AMPRB.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggctctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaacctcctccataaacacagcctacatggagttgaggagcctgacatctgacgacaccggccgtctatttacgtgttggcgagtagtcccacgattccggtgacgcccgtaccggccaggccggtccttttcggtacctttcgtcgggggccccgagggggaccg

SEQ ID NO: 531878 - DNA, 520 bp, Homo sapiens
  misc_feature: HEFZJCU01AUEPI.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctgggagtggggtggccaacataaatgacgatgacaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggaccaggggaacccctgggtccgtcccg

SEQ ID NO: 531879 - DNA, 371 bp, Homo sapiens
  misc_feature: HEFZJCU01A07Q9.3.42.D09.1.454.heavy.3.raw
agacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 531880 - DNA, 512 bp, Homo sapiens
  misc_feature: HEFZJCU01EZ4A7.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccaataaacacagcctacatggagttgaggagcctgaacatctgacgacacggccgtctattactgtgcgagacgtcccacgactccgggtgacgccgtacggcagcggtcctttgactttcgtc

SEQ ID NO: 531881 - DNA, 525 bp, Homo sapiens
  misc_feature: HEFZJCU01C4U8L.3.82.H05.1.454.heavy.3.raw
  modified_base (517)..(517): a, c, t, g, unknown or other
agacgcactccacgaccggtgctcgatttagtcgagctctctcgcggggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtgggttcggggacctcaccctggttctacttcgatctntcggggtc

SEQ ID NO: 531882 - DNA, 503 bp, Homo sapiens
  misc_feature: HEFZJCU01DH92W.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctgggcctcagtgagggtctcctgtaaggcctctggatacatcttcaccgaccacaacatgcactgggtgcgacaggcccctggacaagggcttgagtggatgggctggattaattccaaaagtggtggcacaagactgcacagaagtttcagggcagggtcaccatgaccagggacaagtccaccaacacagacctacatcggaactaagggggacctggacatctgacgacacggccatgtattattgtgcgagagaatgtaggtatgcttggtcctggggcccgggaaccgggtc

SEQ ID NO: 531883 - DNA, 501 bp, Homo sapiens
  misc_feature: HEFZJCU01CE76K.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaatgagctgggtccgccaggctcctgggaaggggccggagtggatttcatacatcagtagtagtggtaacaccttgtactatgcagactctgtgaagggcgattcaccatctccagagacaacgccaagaattcactgtttctgcaaatgaacagcctgagagacgaggatacggcttatttactattgtgcgcgatcgacaagaaaagcggtaggcctagttc

SEQ ID NO: 531884 - DNA, 503 bp, Homo sapiens
  misc_feature: HEFZJCU01DSKQO.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagaggcacacgcggcccgtgggccgtcgccgtcggtcaagggactactttcctacggtgagctctgac

SEQ ID NO: 531885 - DNA, 534 bp, Homo sapiens
  misc_feature: HEFZJCU01DQ1YZ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcggggcccacgtaaccgttactacgtctatgggacgttccgtgggggtaccaagggggaacccg

SEQ ID NO: 531886 - DNA, 373 bp, Homo sapiens
  misc_feature: HEFZJCU01DGNN4.51.75.G09.1.454.heavy.3.raw
cgatcgtatacacgaccggtgctcgatttagtatagacatcagggaggacatactacgcagactccgtcaagggccggttcaccatctccagagacaattccgagaactcggtgtctctgcaaatgagcagcctgagagccgaggacacggccgtatatttctgtgcgaaagacttcggacaactggaagtacgtatgttcgcattcagcagctactacggtatggacgtctggggccaagggaccacggtcaccgtctcctcagcctccaccaagggcccatcggtcttccccctggcaccctcctccaagagcacctctgggggcacagcggcctgggctgcctggtcaaggactacttcctcgtagcact

SEQ ID NO: 531887 - DNA, 505 bp, Homo sapiens
  misc_feature: HEFZJCU01A1CP0.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcaggcagggtcaccgatgacctgggacgcgtccatcagcacagtctcatggatctgagcggactgacctctgacgacacggccatgtattactgtggaagagacgttggtggctaccgcgggggcctggaccactcgggggaccg

SEQ ID NO: 531888 - DNA, 515 bp, Homo sapiens
  misc_feature: HEFZJCU01DYO79.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctacttattgtgtcatagacctaggatacaacgacggtggtacctggt

SEQ ID NO: 531889 - DNA, 545 bp, Homo sapiens
  misc_feature: HEFZJCU01AXTRK.17.28.C06.1.454.heavy.3.raw
  modified_base (442)..(442): a, c, t, g, unknown or other
  modified_base (499)..(499): a, c, t, g, unknown or other
  modified_base (530)..(530): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacngcctgagagtcgcagacacggccgtgtattactgtgcgagatgtaggaaaaagtaangggctgttgtttagttgggggccaggggacncccctggtcctaccg

SEQ ID NO: 531890 - DNA, 511 bp, Homo sapiens
  misc_feature: HEFZJCU01CWJW8.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttactattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctcacgagacaacgccaagaactcactgtatctgcaaatgaacagcctgagagccgaggacacggctgtgtattactgtgcgagaggagctattatcgtaggaaccccgatgtctttttg

SEQ ID NO: 531891 - DNA, 519 bp, Homo sapiens
  misc_feature: HEFZJCU01E03CW.48.81.H04.1.454.heavy.3.raw
  modified_base (467)..(467): a, c, t, g, unknown or other
agtatacatacacgaccggtgctcgatttagtagtgtagattcgcggggacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggcatttactactgtgcgcggggaggtggacggngcgtcggttttcggagttatcatcgtactactttagaatcgttggggacccc

SEQ ID NO: 531892 - DNA, 516 bp, Homo sapiens
  misc_feature: HEFZJCU01D3VVN.17.25.C03.1.454.heavy.3.raw
  modified_base (310)..(310): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggngaaccctaacactggtgtcacagtgtcttcacccatccctccgggacagacttaccatgaccacgaactcctccataaacacagcctacatggagttgaggagcctgacatctgacgacacggcgtcctattactgtgcgagagtcccacgatccggtgagccgtacggcacggcggccgtttgactttcgtggggccaggggacg

SEQ ID NO: 531893 - DNA, 512 bp, Homo sapiens
  misc_feature: HEFZJCU01CA0L7.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccggggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggaacctc

SEQ ID NO: 531894 - DNA, 492 bp, Homo sapiens
  misc_feature: HEFZJCU01BKWDB.49.82.H05.1.454.heavy.3.raw
agtcgagagacacgaccggtgctcgatttagtcgagctctctcgcggggagctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctcagagacaacgccaagaactcactgtatctccaaatgaacagcctgagagtcgaggaccacggctgtctagttactgtgcgagagatcccaacagc

SEQ ID NO: 531895 - DNA, 541 bp, Homo sapiens
  misc_feature: HEFZJCU01B82OS.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcggagggccttcgggtttaccgttcgtagtgtccgttcggtttggtagaacgttaggggaccgacggggaacgtaccgtggtacgtaccgtccgttcccttcctacggccctccaaccc

SEQ ID NO: 531896 - DNA, 512 bp, Homo sapiens; identical to SEQ ID NO: 477514
  misc_feature: HEFZJCU01A7CH2.15.67.G01.1.454.heavy.3.raw
  modified_base (482)..(482): a, c, t, g, unknown or other

SEQ ID NO: 531897 - DNA, 379 bp, Homo sapiens; identical to SEQ ID NO: 445912
  misc_feature: HEFZJCU01DRPJE.47.77.G11.1.454.heavy.3.raw

SEQ ID NO: 531898 - DNA, 525 bp, Homo sapiens
  misc_feature: HEFZJCU01EDF4B.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaacgggcccatcggtcttccccctggcaccctcctccaagagcacctcgtgggggccacagcggccctgggctcgcctggtacaaggacctacttccagacgtatca

SEQ ID NO: 531899 - DNA, 503 bp, Homo sapiens
  misc_feature: HEFZJCU01DVR70.9.12.B01.1.454.heavy.3.raw
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaatagaacagcctgagagtcgaggacacggctgtatattacttgtgcgagagatggtgtacgtcttttgtatactcgt

SEQ ID NO: 531900 - DNA, 546 bp, Homo sapiens
  misc_feature: HEFZJCU01D3F8K.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattacgtgtgcgagatgtaggaaaaagttaatggtcgtgtgtttagttggggccaggggagccccgtggtccgaccg

SEQ ID NO: 531901 - DNA, 502 bp, Homo sapiens
  misc_feature: HEFZJCU01DEMVD.13.79.H02.1.454.heavy.3.raw
tcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccaggggaaggggctggagtgggtgccaacataaagcaagttggaagtgagaaatctatgtggactctgtgaagggccattcaccatctccagagacaacgccaagaactcactgtatctgcaaatgaacagcctgagagccgaggacacggctgtcttattactgtgcgagagagttggggcggaaggtatagca

SEQ ID NO: 531902 - DNA, 497 bp, Homo sapiens
  misc_feature: HEFZJCU01CLCT7.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactggacctcgtgacgacgacggccatgtattactgtggaacgagacgttggtggctaccgcggggctggaccac

SEQ ID NO: 531903 - DNA, 520 bp, Homo sapiens
  misc_feature: HEFZJCU01A3AS9.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccgatgaccacagacacatcagcgaacacagtcaacatggagttgcggagcctgcgatctgacgacgcggccgtatattactgtgcgagagtacgtagcggctcgtcctttgacttacgtggggcctgggaactcgtggtccaccgtctccc

SEQ ID NO: 531904 - DNA, 523 bp, Homo sapiens
  misc_feature: HEFZJCU01DIIJQ.10.35.D02.1.454.heavy.3.raw
catagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtcccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaaagagtacccacgaagactggtagggaagggacgt

SEQ ID NO: 531905 - DNA, 527 bp, Homo sapiens
  misc_feature: HEFZJCU01C7RTE.16.86.H09.1.454.heavy.3.raw
  modified_base (499)..(499): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctcgatagcagtggctggtccactaggtttgacttacgtggggccaggggaancgttggtcaccgtctcctcagcctaccg

SEQ ID NO: 531906 - DNA, 487 bp, Homo sapiens
  misc_feature: HEFZJCU01EPT9D.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcaggggtcaccatgaccagggacacgtccatcagcacagcctacatggagctacacggcctgagatctgacgacacggccctgttatttttgtgcgagagagtctattaaagtggc

SEQ ID NO: 531907 - DNA, 508 bp, Homo sapiens
  misc_feature: HEFZJCU01DQZPR.11.21.B10.1.454.heavy.3.raw
cgagagataccacgaccggtgctcgatttagtgtcgtcgcaagatagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctaatggcatgcactggggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgaagagctgaggacacggctggtgttattactggtgcgaaagattttctataggtaggtgacgtac

SEQ ID NO: 531908 - DNA, 506 bp, Homo sapiens
  misc_feature: HEFZJCU01BVIV0.3.82.H05.1.454.heavy.3.raw
  modified_base (486)..(486): a, c, t, g, unknown or other
agacgcactccacgaccggtgctcgatttagtcgagctctctcgcggggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgtagactctcctgtgcagcctctggcttcaccgtcagtagcagctacatgcactgggtccgccaggctccaggggaagggctggagtgggtctcagttatttacaattctggtacctacatactactccgaaccccgttgaagggccggattaaccatactccagaggacgattccgagaaccacggtgtatcgttctaaatgaaacaacctgagagccgacgacacggccggtttaattacgtgtgcgtagngattcggagtgggttcgggg

SEQ ID NO: 531909 - DNA, 529 bp, Homo sapiens
  misc_feature: HEFZJCU01BITP0.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctaggagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtcgtggggccaagggaccacggtcatccgtcctccccacgcctccacccaacggggcccaagtccggtcttcccccttcggccggccctcgcctccacggagc

SEQ ID NO: 531910 - DNA, 430 bp, Homo sapiens; identical to SEQ ID NO: 471364
  misc_feature: HEFZJCU01B7E5B.4.37.D04.1.454.heavy.3.raw

SEQ ID NO: 531911 - DNA, 533 bp, Homo sapiens
  misc_feature: HEFZJCU01CRPEV.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacgggccgtgtattactgtgcgagagatggggcccacgaacgtttactacgctatggacgtcgtgggggtccaaggggacccac

SEQ ID NO: 531912 - DNA, 504 bp, Homo sapiens
  misc_feature: HEFZJCU01DGTLR.51.86.H09.1.454.heavy.3.raw
cgatcgtatacacgaccggtgctcgatttagtgctatagacttgggtttgggctatagacttgggtttggggggaagaggaagactgacggtcctcccaggtgtccagtgtcaggtgcagctggtggactctggggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaaggccgattcaccatctccagagacaattccaagaacactctatatttgcagatgaatagcctgagaattgaggacacggctgtgtattactgtgtgagagggtcggcatattccggttttgagtaattatctactggtaactttgatatctggggccacgggacaatgtcaccgtctcttcagcttccaccacggccc

SEQ ID NO: 531913 - DNA, 533 bp, Homo sapiens
  misc_feature: HEFZJCU01EAYF1.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaagggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactggtgcgagagatgggggcccacgaacgttactaacgctatggacgtcgtggggccgaagggaccgacc

SEQ ID NO: 531914 - DNA, 521 bp, Homo sapiens
  misc_feature: HEFZJCU01C77PF.10.38.D05.1.454.heavy.3.raw
  modified_base (505)..(505): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccagggcctccaggggaaggggctggagtgggtctcagttattgaaaacagatggcactacatattattctgactccgtgaagggccggttcaccctctccagagacacttccaacaacatcttgtatctttcacatgcacaatctagagagtcgacgacacggccacctattattgtgcgcgacatgaccgtacgcctacaactttcgnggggtccgaggggacg

SEQ ID NO: 531915 - DNA, 516 bp, Homo sapiens
  misc_feature: HEFZJCU01DEE63.17.25.C03.1.454.heavy.3.raw
cgtagactagcacgaccggtgctcgatttagtagtgtagatttgggtttggggaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggcgaaccctaacactggtgtcacagtgtcttcacccatcctccgggacagacttaccatgaccacgaactcctccataaacacagcctacatggagttgaggagccgtgacatctgacgacacggccgtctattactgtgcgagagtcccacgatccggtgacgcctacggcagcgggtcctttgtacttctgggggccctaggggaccg

SEQ ID NO: 531916 - DNA, 503 bp, Homo sapiens
  misc_feature: HEFZJCU01A645U.51.59.F04.1.454.heavy.3.raw
cgatcgtatacacgaccggtgctcgatttagtacacacacttagggattggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaatgaacagcctgagagctgaggacacggctatgttttactgtgcgagagggaactcgattacagcacgcctacg

SEQ ID NO: 531917 - DNA, 545 bp, Homo sapiens
  misc_feature: HEFZJCU01D09NA.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatggggaatacgattttcgatccctccgcagtcgacactttgattactggggccggggaaccctggtcgccgtctcctcagcctccaccaagggcccatccggtcttccccctggccaccctcctccaagagcacctcgtgggggcacagcggccccttggggccttggcccgttggtccaagggacctacgttccctagaccgtaatcactgaac

SEQ ID NO: 531918 - DNA, 538 bp, Homo sapiens
  misc_feature: HEFZJCU01DDAZ8.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaacgtgaggaagtctgacatctgacgacacggccatatatttactgtgcgagaaggacggtttttgggggcggcgggactcctccttgtagatcgtggggtccagggggacaaagtgggtacaccggtcctctttcc

SEQ ID NO: 531919 - DNA, 504 bp, Homo sapiens; identical to SEQ ID NO: 455141
  misc_feature: HEFZJCU01C8UAW.17.25.C03.1.454.heavy.3.raw

SEQ ID NO: 531920 - DNA, 495 bp, Homo sapiens
  misc_feature: HEFZJCU01BTS4I.10.71.G05.1.454.heavy.3.raw
  modified_base (492)..(492): a, c, t, g, unknown or other
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttatactgtgggagaatcctagtggntac

SEQ ID NO: 531921 - DNA, 543 bp, Homo sapiens
  misc_feature: HEFZJCU01CKUOC.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccgagggaacccgtggtcaccgtcctcctcacgcctccaccgaacgggaccccg

SEQ ID NO: 531922 - DNA, 580 bp, Homo sapiens
  misc_feature: HEFZJCU01BPHRK.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaaccctactcggcccaaatacttaagtggggggtctttggttccttgggggtcccgacgggggaaccccgtgggtccatccgtcctcccccacgcccttcccaaccaaccggggacccaacgtccgggttcctttcccccgtcgggtccgtccccgtcg

SEQ ID NO: 531923 - DNA, 520 bp, Homo sapiens
  misc_feature: HEFZJCU01CM2NW.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaggggctggaatgggtctcaggtattactggtggtggttataccacatactacgcagactccgtgaagggccggttcacctagtcctccagagacaattccaagaacacactgtatctgcaaatgaacagcctgagagccgacgacacggccatatattacgtgtgcgaaagctaccggacagttagtcaacccattactactttcgactaccgtgggaccc

SEQ ID NO: 531924 - DNA, 481 bp, Homo sapiens
  misc_feature: HEFZJCU01EJMTN.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggccctgggctgcctggtcaaggctacttccgtatctctcg

SEQ ID NO: 531925 - DNA, 520 bp, Homo sapiens
  misc_feature: HEFZJCU01BFSGA.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaaagtgcaactggtggagtctgggggaggcgtggtccagcctgggaggtcacagagactctcctgtgcagcctctgggttcaccttcagtagctacggcatgcactgggtccgccaagctccaggcaaggggattggagtggggtggcagtttgtttcatctgagggcagtgttcaatggtatgcagactccgtgaagggccgattcaccatctccagagacaattccaggaaccacaaatgtatttggaaatgaacagacctaagtacctgaggacacgggtagtatactactgtacgaaggagggggaacgagcgggagtcaagtactccttgacgtcgtgggcc

SEQ ID NO: 531926 - DNA, 495 bp, Homo sapiens
  misc_feature: HEFZJCU01DZYEQ.10.85.H08.1.454.heavy.3.raw
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctagtggttcgg

SEQ ID NO: 531927 - DNA, 500 bp, Homo sapiens
  misc_feature: HEFZJCU01CVHW1.49.19.B08.1.454.heavy.3.raw
agtcgagagacacgaccggtgctcgatttagtgagtcagtaaggggctgggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaaatgaacagcctgaaagttgacgacacgggtctttttactgtgcgcctgaagcagtggctggccacatgatgctttt

SEQ ID NO: 531928 - DNA, 508 bp, Homo sapiens
  misc_feature: HEFZJCU01EAH9V.51.51.E07.1.454.heavy.3.raw
cgatcgtatacacgaccggtgctcgatttagcatactctacaacacacaaaggggctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctggggggaggcgtggtccagcctggggaggtccctgagactctcctgtgtagcctctggattcaccttcagggtctatgacatgcacgtgggtccgccaggctccaggcaaggggctggagtgggtggcatttgtatcaaatgatggaaataagaaatactatatagactccgtgaggggcgattcgccatctccagagacaattccaagaacacactgtatctgcacatgaacagcctgagagccgaagacgacgggtgtttactactgtgcgaacttaatacggtaggacaacgtaccg

SEQ ID NO: 531929 - DNA, 523 bp, Homo sapiens
  misc_feature: HEFZJCU01EHF2I.10.85.H08.1.454.heavy.3.raw
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccaggccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatattttctgtgcggagggggagccggctagtggttcggacctcgtggggccaggggaaccctggt

SEQ ID NO: 531930 - DNA, 531 bp, Homo sapiens
  misc_feature: HEFZJCU01AS59F.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgattttggagtggtaaccccttggctactggggccagggaaccctggtcaccgtctcttcagcctccaccaagggccctacg

SEQ ID NO: 531931 - DNA, 531 bp, Homo sapiens
  misc_feature: HEFZJCU01DGEJW.4.57.F02.1.454.heavy.3.raw
  modified_base (449)..(449): a, c, t, g, unknown or other
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgagacacggctagtctattattgtgcgagagtaagtggtcatggtccttttgaccagtggggccagggaaccctggtcaccgtctcctcagcttccnccaagggcccatcggtccttcccctcggccgccctcgcctccgaggacgcaccctcgtcggggggcacgacggccggtcccc

SEQ ID NO: 531932 - DNA, 513 bp, Homo sapiens
  misc_feature: HEFZJCU01DD9LH.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacagtaaacaagacggaagtcagaaaactatgtggactctgtgaacggccgattcaccatctccagagacaacgccaagaattcactgtatttgcaaatgaacagcctgagaggcgaggaccacggccgtagtattattgtgcgcgagatgatagtagactctacagtagcaggtggta

SEQ ID NO: 531933 - DNA, 513 bp, Homo sapiens
  misc_feature: HEFZJCU01EIWF3.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccggactacaacccgtccctcatgagtcgagtcaccatgtcagtggactcgtccaagagtgagttctccctgaggctgacgtctttaagtgtcgctgatacgggtgtctatttctgtgcgagactcgcccgtcctgcacctcgtgtcggcccaatttggtttaccggcacacaaaatcaggcaagtcctacgacggtctggtac

SEQ ID NO: 531934 - DNA, 514 bp, Homo sapiens
  misc_feature: HEFZJCU01CCO1U.52.83.H06.1.454.heavy.3.raw
  modified_base (444)..(444): a, c, t, g, unknown or other
  modified_base (460)..(460): a, c, t, g, unknown or other
cgcagtacgacacgaccggtgctcgatttagatcacgtgcgtcgcggggtctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcagtttatatcaaatgatggaagtaacaaatactatgtagactccgtgaagggccgattcaccatctccagagacaattccaagaatacgctgtatctgcacatgaacagcctgagngaccgagacacgggtntttattactgtgcgaactttaatacggaggacaacggtaacccccgtccgaccg

SEQ ID NO: 531935 - DNA, 506 bp, Homo sapiens
  misc_feature: HEFZJCU01CN1ZB.9.34.D01.1.454.heavy.3.raw
  modified_base (468)..(468): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatccctccgcagtcgacactttgattactggggccgggaacctggtcgccgtctcctcagcctccaccaaggcccatcggtcttcccctggcaccctcctccaagagcacctctgggggcncagcgcctggctgcctgcaaggctactcagacgtatca

SEQ ID NO: 531936 - DNA, 494 bp, Homo sapiens
  misc_feature: HEFZJCU01DW3C6.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactgggccagggaaccctggtcaccgtctcctcagcctccaccaacgggccatcggtcttcccctggccgccctgcctcaggagcacctccgagagcacagccggccgtcgggct

SEQ ID NO: 531937 - DNA, 516 bp, Homo sapiens
  misc_feature: HEFZJCU01ANDTQ.4.57.F02.1.454.heavy.3.raw
  modified_base (505)..(505): a, c, t, g, unknown or other
agcactgtagcacgaccggtgctcgatttagctcgatatagttggggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgtagagccgaggacacggctgtctattattgtgcgagagtaagtggtcatggtccttttgaccagtggggccagggaaccctggtcaccgtctcctcagcttccaccaagggcccatcggtctcccctggcgccctgctccagagcacctcgtggggcncgagcggcccg

SEQ ID NO: 531938 - DNA, 523 bp, Homo sapiens
  misc_feature: HEFZJCU01CPFNB.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagtttttggctgagctgggttttccttgttgctatttttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattactgtgcgagagagtggggcccaacgaacgttactaacgctatggacgtctggggccaagggacc

SEQ ID NO: 531939 - DNA, 531 bp, Homo sapiens
  misc_feature: HEFZJCU01DJYRZ.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctcctcaggagtccagtcgccatatccctggactcgtccaacaaccagatctccctgacgatgacatctgtgaccgctgcggacacagccgtttattactgtgcgcgatctgggcgactcagtgactatggtagtggacgtcgtcggggccgaacgggaccgacggtcatcgtcctcctccacgcctccaccgaacgggcccacgtccggttccttcccccgtcggccta

SEQ ID NO: 531940 - DNA, 516 bp, Homo sapiens
  misc_feature: HEFZJCU01BRJO4.15.67.G01.1.454.heavy.3.raw
  modified_base (474)..(474): a, c, t, g, unknown or other
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaagggctggagtgggtggccaacataaacaaagacggaagtcagaaaaactatgtggactctgtgaacggccgattcaccatctccagagacaacgccaagattacactgtatttgcaaatgaacagcctgagaggcgaggacacggccgtgtattattgtntcggcgagatgatagtagacctctacgagtagctaggtggta

SEQ ID NO: 531941 - DNA, 514 bp, Homo sapiens
  misc_feature: HEFZJCU01BR2RR.51.71.G05.1.454.heavy.3.raw
cgatcgtatacacgaccggtgctcgatttagtgtcgtcgcaagagagaggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattcgaccatctccagacgacaactcgaagaatacggttcttctacaaatgaacagcctgagagcgtgaggacgacggctagttcgttttacgttgtgcgaggagggaactcgattacagcagccctacgaacg

SEQ ID NO: 531942 - DNA, 520 bp, Homo sapiens
  misc_feature: HEFZJCU01D8PCN.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacgttcgatctcgtc

SEQ ID NO: 531943 - DNA, 529 bp, Homo sapiens
  misc_feature: HEFZJCU01B1O9G.16.27.C05.1.454.heavy.3.raw
  modified_base (520)..(520): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgtctcttgactacgtgggggccgggacgcccggtnatcgtctcc

SEQ ID NO: 531944 - DNA, 521 bp, Homo sapiens
  misc_feature: HEFZJCU01CG85C.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggggaacccgtgggtcgccgtctcctcagcctccaccaagggcccatcggtcttccccctggccaccctcctccaagagcacctctgggggcacagcggcctgggctgcctggtcaaggactactccagacgtatca

SEQ ID NO: 531945 - DNA, 390 bp, Homo sapiens
  misc_feature: HEFZJCU01BX3FX.13.70.G04.1.454.heavy.3.raw
tcacgtactacacgaccggtgctcgatttagtgtagtgtgaagggaaagggactagagtgggtctcagatattagtggtagtggtggtagcacatctcatgtagactccgtgaagggccggttcaccatctccagagacaattccaagaacacgatgattctgcaaatgaacagcctgagagtcgaggactcggccctttattactgtgtgaaaagaactaccatgacgcgcgggccttttgactactggggccagggaattctggtcaccgtctcctcagcctccaccaagggcccatccgtcttccccctggcgccctgctccaggagcacctccgagagcacagcggccctgggctgcctggtcaaggactacttcctagtacgtga

SEQ ID NO: 531946 - DNA, 509 bp, Homo sapiens
  misc_feature: HEFZJCU01ERWH2.22.86.H09.1.454.heavy.3.raw
  modified_base (498)..(498): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttccccctggccgcccngctccaggacg

SEQ ID NO: 531947 - DNA, 519 bp, Homo sapiens
  misc_feature: HEFZJCU01AVC8J.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacaccgtccaagaaccagttttccctgacgctgacgtctgtgaccgccgcgagacacggctgtctattattgtgcgagactagccttctgtaggtgggggtacttgcaacccgggatactactccaccttcggcttggacatctgggccgac

SEQ ID NO: 531948 - DNA, 513 bp, Homo sapiens
  misc_feature: HEFZJCU01EN6C4.49.30.C08.1.454.heavy.3.raw
agtcgagagacacgaccggtgctcgatttagtctgacgtcaaagggaaaggggctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctccaggaaagggctggagtgggtctcacttatttatagtggcggtaacacaaggtacgcagactccgtgaggggccgattcaccatctccagagacagttccaagaacaccctgtatcttacaaatgaacagtctgagacctgacgacacggctgtctattactgtgcagtattcactctcttgtagtacgtggggccagggactcccg

SEQ ID NO: 531949 - DNA, 511 bp, Homo sapiens
  misc_feature: HEFZJCU01DVLYE.17.33.C11.1.454.heavy.3.raw
  modified_base (494)..(494): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgnagcctccaccaaggccc

SEQ ID NO: 531950 - DNA, 507 bp, Homo sapiens
  misc_feature: HEFZJCU01EB64T.48.28.C06.1.454.heavy.3.raw
agtatacatacacgaccggtgctcgatttagagctcacgtattgggtttggggtctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaaggccgattcaccatctccagagaagacgccaagaattccttgtaatcttcagatgaacagtctgagaaccgatgacacggactgtgtattattgtgacgaaaaggggggagcgagctcgtccactccta

SEQ ID NO: 531951 - DNA, 492 bp, Homo sapiens
  misc_feature: HEFZJCU01EVP51.14.25.C03.1.454.heavy.3.raw
  modified_base (396)..(396): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagngacaattccaagaacacgcagtatctgcaatgaacagcctgagagctgaggacacggctgtgtattactgtgggagagatggaggtcgatattgta

SEQ ID NO: 531952 - DNA, 524 bp, Homo sapiens
  misc_feature: HEFZJCU01BK0SP.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgaccatctgacgacacggccgtctattactgtgcgagagtcccacgatcccgggtgacgccctacgggccaggccggtccttttggactttcgtgggggccaggggacg

SEQ ID NO: 531953 - DNA, 525 bp, Homo sapiens
  misc_feature: HEFZJCU01EUYSU.52.57.F02.1.454.heavy.3.raw
  modified_base (471)..(471): a, c, t, g, unknown or other
cgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtctggggccaagggaccacggtcaccgtcgcctcagcctccaccaagggcccatcggtcttcccctggcaccctcctccaagagcacctntgggggcacgagcggccctgggctgcctggtcaaggactactcctatacgatcg

SEQ ID NO: 531954 - DNA, 534 bp, Homo sapiens
  misc_feature: HEFZJCU01B7A95.14.55.E11.1.454.heavy.3.raw
cgtctagtaccacgaccggtgctcgatttagcactcgcacgttgggtttgggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtcgtggggccaagggaccacggtcaccgtctcctcagcctccaccaagggcccatcggtcttccccctggccaccctcctccaagagcacctcgtgggggcacgagcggccctgggctgcctggtcaaggactacgttaccg

SEQ ID NO: 531955 - DNA, 510 bp, Homo sapiens
  misc_feature: HEFZJCU01C2VLI.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagccgtgacatctgacgacacggccgtctattactgtgcgagagtcccacgactccgggtgagcctacggcaggcggcctttgacctttcgtc

SEQ ID NO: 531956 - DNA, 502 bp, Homo sapiens
  misc_feature: HEFZJCU01AK3MW.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaacgatagctttgatatgtggggcaagggactacg

SEQ ID NO: 531957 - DNA, 490 bp, Homo sapiens
  misc_feature: HEFZJCU01CT99N.52.2.A02.1.454.heavy.3.raw
cgcagtacgacacgaccggtgctcgatttagactcatctacaggggctgggagaggagcccagcactagaagtcggcggtgtttccattcggtgatcagcactgaacacagaggactcaccatggagtttgggctgagctgggttttcctcgttgctctgggagaggtgtccagtgtcaggtgcaggtggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaaaatatactatgtagactccgtgaagggccgattcatcatctccagagacaattccgagaacaccctgtatctgcaaatgaacagcctgagagctgaggacacggctgtgtattactgtgcgaacttatcacggaggactaacc

SEQ ID NO: 531958 - DNA, 496 bp, Homo sapiens
  misc_feature: HEFZJCU01DVUZ8.14.25.C03.1.454.heavy.3.raw
cgtctagtaccacgaccggtgctcgatttagtagtgtagatttgggtttgggggagacgagcccagcactggaagtcgccggtgtttccattcggtgatcagcactgaacacagaggactcaccatggagtttgggttgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagaggctgaggacacggctgtgtattactgtgggagagatggaggtcgatatgtagt

SEQ ID NO: 531959 - DNA, 508 bp, Homo sapiens
  misc_feature: HEFZJCU01DV5FP.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctccgtcaatggctttcattacg

SEQ ID NO: 531960 - DNA, 526 bp, Homo sapiens
  misc_feature: HEFZJCU01ELHIR.16.2.A02.1.454.heavy.3.raw
tgtactactccacgaccggtgctcgatttagactcatctacagggggagagaggagccttagccctggattccaaggcctatccacttggtgatcagcactgaccaccgagaattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatctcagtatctataacatgaactgggtccgccagactccagggaaggggctggagtgggtcgcatccattagtggtggtaataattacatatactacggagactcaatgaagggccgcttcaccatctccagagacaacgaccgaaaactcactgtatctgcagatagaacagcctgagacgccgaagacacggctgtagtattactgtgcgaggaggtcttacttataggtttcgggggagtttaataataacgtacttatttcgta

SEQ ID NO: 531961 - DNA, 498 bp, Homo sapiens
  misc_feature: HEFZJCU01EYA0G.48.9.A09.1.454.heavy.3.raw
  modified_base (494)..(494): a, c, t, g, unknown or other
agtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagttgggcccaggactggtgaagccttcggagaccctgtccctcacgtgcactgtctctggtgactccatcaacaatagtcattactactggggctggatccgccagtccccagggaaggggctggagtggattggaattatctattatagcgggagcacctactataatccgtccctcaagagtcgagtcaccatatccgtagacacatccaagaaccagttctccctgaggctgagccctgtcgaccgccgcagacacggctgtctattactgtgcgacccatcgatatcatgactggttnttac

SEQ ID NO: 531962 - DNA, 533 bp, Homo sapiens
  misc_feature: HEFZJCU01DID7J.10.44.D11.1.454.heavy.3.raw
catagtagtgcacgaccggtgctcgatttagcgcagtacgaagggggggagagggagcccagcactagaagtcggcggtgtttccattcggtgatcagcactgaacacagaggactcaccatggagttttgggctgaactgggttttcctcgttgctcttttaagaggtgtccagtgtcaagtgcaactggtggagtctggggggaggcgtggtccagcctggggaggtcacagagactctcctgtgcagcctctgggttcaccttcagtagctacgggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaaggacgacgggtgtatactactgtacgaagggaggggggaaccaggcggggagtccaagtacctccttgacgtcgtcggggcctac

SEQ ID NO: 531963 - DNA, 508 bp, Homo sapiens; identical to SEQ ID NO: 445594
  misc_feature: HEFZJCU01B642A.17.25.C03.1.454.heavy.3.raw

SEQ ID NO: 531964 - DNA, 499 bp, Homo sapiens
  misc_feature: HEFZJCU01EWN6Q.49.8.A08.1.454.heavy.3.raw
agtcgagagacacgaccggtgctcgatttagcatactctacaggggtgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaagggggctggagtgggtggcatttatctcatatgatggaagcaagatatactacattgactccgtgaagggccgattcatcatctccagagacaactccgagaacacactgtatcttcaaatgaactaggttgagagctgaaagacacggctttatattactgtgcgaacttaatcacgggagacgtaacggtcc

SEQ ID NO: 531965 - DNA, 523 bp, Homo sapiens
  misc_feature: HEFZJCU01EJO6Y.47.6.A06.1.454.heavy.3.raw
  modified_base (430)..(430): a, c, t, g, unknown or other
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcgacacggccgtgtnttactgtgcgagccacaccgattacgatttttggagtggccttgataacgtgggccaggggatctggtcaccgtctcctcagcctccaccaac

SEQ ID NO: 531966 - DNA, 504 bp, Homo sapiens
  misc_feature: HEFZJCU01CAOG6.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctggctgcctggtcaaggactacttcctatgtatact

SEQ ID NO: 531967 - DNA, 513 bp, Homo sapiens
  misc_feature: HEFZJCU01DAJ4G.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcacctggtcaccgtctcctcagcttccaccaagggcccatcggtccttccccgtggccgccctgcctccgtacggagcacctcgtgggggtcacgacgcggcccgtgggcctggtccgtcggtcgtaa

SEQ ID NO: 531968 - DNA, 530 bp, Homo sapiens
  misc_feature: HEFZJCU01AXT3M.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatcggaacccggtaccg

SEQ ID NO: 531969 - DNA, 546 bp, Homo sapiens
  misc_feature: HEFZJCU01A440T.17.28.C06.1.454.heavy.3.raw
  modified_base (371)..(371): a, c, t, g, unknown or other
  modified_base (442)..(442): a, c, t, g, unknown or other
  modified_base (460)..(460): a, c, t, g, unknown or other
  modified_base (475)..(475): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaagggctggagtgggtggccaacataaagcaagatggaactgccgagttttacgnggactctgtgaagggcctttcgaccatctccagagacaacgccaagaattcactgtatctacaactgaacngcctgagagtcgcagacncggccgtgtattacngtgcgtagatgtggaaaaagtactggctgtgtttacgttgggggacctaggggatccccgtggtcctaccg

SEQ ID NO: 531970 - DNA, 508 bp, Homo sapiens
  misc_feature: HEFZJCU01BLNZ3.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaatgaacagtctgagagccgaggacacggctctctattactgtgcggagacgccccgaaagtac

SEQ ID NO: 531971 - DNA, 496 bp, Homo sapiens
  misc_feature: HEFZJCU01DV3IW.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaaggccgattcaccgtctccagagacaattccaggcacacgctgtatctgcaaatgaacagcctgagagctgaggacgacggctggtgtattacgtgtgcgaaagatttctagta

SEQ ID NO: 531972 - DNA, 504 bp, Homo sapiens
  misc_feature: HEFZJCU01EFQ7Z.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgtccttcctgcagtggcgcagcctggaggcctcggacaccgccatatattactgtgcgagtccggttatcgccgcagatcactactactactacggtctggacgtc

SEQ ID NO: 531973 - DNA, 505 bp, Homo sapiens
  misc_feature: HEFZJCU01EKQTK.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacccgtaacactggtgtcacagtgtcttcacccatcctccgggacagacttaccatgaccacgaactcctccataaacacagcctacatggagttgaggagcctgacatctgacgacacggccgtctattactgtggcgagagtcccacgatccgggtagagcctacggcagcggcctttgacttc

SEQ ID NO: 531974 - DNA, 503 bp, Homo sapiens
  misc_feature: HEFZJCU01A4VJK.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttattactgtgcgcgagataatagtctacaacgtggaacggcggttttggggtggttc

SEQ ID NO: 531975 - DNA, 515 bp, Homo sapiens; identical to SEQ ID NO: 460635
  misc_feature: HEFZJCU01ESRO1.46.67.G01.1.454.heavy.3.raw

SEQ ID NO: 531976 - DNA, 488 bp, Homo sapiens
  misc_feature: HEFZJCU01B3TE8.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtaatattattgtgcccttgattacta

SEQ ID NO: 531977 - DNA, 518 bp, Homo sapiens
  misc_feature: HEFZJCU01EUKL2.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacctacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggccccatcc

SEQ ID NO: 531978 - DNA, 495 bp, Homo sapiens
  misc_feature: HEFZJCU01BFDYW.48.27.C05.1.454.heavy.3.raw
agtatacatacacgaccggtgctcgatttagacgcgatcgaagggtttggggagctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggagtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaagggccgattcgccttctccagagacaattccaagagcacggttcatctgcaaatgagcgccctgagacctgacgacacggctgtctattactgtgcgagagggcgtcggagtttaac

SEQ ID NO: 531979 - DNA, 525 bp, Homo sapiens
  misc_feature: HEFZJCU01BF1U4.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagataggggcccacgaacgttactacgctatggacgtctggggccaagggaccac

SEQ ID NO: 531980 - DNA, 533 bp, Homo sapiens
  misc_feature: HEFZJCU01EO18A.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcgttatctgcagataaccaaccttacaacctgacgacactgccgtttatttttgtacgagagcgtcgtctgtcagtgaattgactactgggcgagggaacccgtggtccacgtctcctcacgcctccaccacgg

SEQ ID NO: 531981 - DNA, 541 bp, Homo sapiens
  misc_feature: HEFZJCU01CHPG6.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaaatggctgtgttttattgggggccaggggagcccgtggtctaccg

SEQ ID NO: 531982 - DNA, 495 bp, Homo sapiens
  misc_feature: HEFZJCU01DUHYS.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaaagaacacgcagtatctgcaaatgaacagcctgagagctgaggacacggctgtgtattactgtgggagagatggaggtcgagtattgta

SEQ ID NO: 531983 - DNA, 493 bp, Homo sapiens
  misc_feature: HEFZJCU01BTI5G.51.1.A01.1.454.heavy.3.raw
cgatcgtatacacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcaggttatagtcatatgatggaagtaatatatactatgtagactccgtgaagggccgattcatcatctccagagacaattccgagaacacgctgtatctgcaaatgaacagcctgagagttgaggacgacggctgtgtattatttgtgcgaacttaatcacggaggaacg

SEQ ID NO: 531984 - DNA, 528 bp, Homo sapiens
  misc_feature: HEFZJCU01AW8C3.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctaccagagacaattccaagaactaggggtgtttctccaagtgattgatctgagaagtgaggacacggctgtttattactgtgcgcggtggctgaccgctcttgactactgggggccggggagcccggtcatcgtct

SEQ ID NO: 531985 - DNA, 526 bp, Homo sapiens
  misc_feature: HEFZJCU01CB9SC.13.71.G05.1.454.heavy.3.raw
tcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccgggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgacaaaatacgcatactacgtaattcaccggtctactactacaacggtatggacgtctggggccagggacccacggtcaccgtctcctcagcctccaccaacgggcccagtcggtcctttcccctcggccta

SEQ ID NO: 531986 - DNA, 517 bp, Homo sapiens
  misc_feature: HEFZJCU01EF9FX.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggtagttattagtccctactttgtactactggggccaggggaactctggtcaccgtctccgcagcctccaccaacgggccc

SEQ ID NO: 531987 - DNA, 512 bp, Homo sapiens
  misc_feature: HEFZJCU01A0O29.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacattctgacgacacggccgtctattactgtgcgagagtcccagatcccgggtgacgcctacggccaggccggtccttttgacttccgt

SEQ ID NO: 531988 - DNA, 394 bp, Homo sapiens
  misc_feature: HEFZJCU01DMSS1.48.75.G09.1.454.heavy.3.raw
agtatacatacacgaccggtgctcgatttagtatagacatcagggaaggccctggagtggcttgctctcatttactgggatactgatgaccgctacactccagctctgaaaacaggctcaccatcgccatggacacctccaaaaacaggtggtccttaaaatgaccaacatggacccaatggacagcgcgacatattactgtgcacacattgattgtggtcccaccaggtgtcccgggcctttgatatctggggccggggacattcgtcaccgtctctgcagcctccaccaagggcccatcggtcttccccctggcgccctgctccaggagcacctccgagagcaccagccggccctgggcctgcctggtcaaggactacttcctatgtatact

SEQ ID NO: 531989 - DNA, 525 bp, Homo sapiens
  misc_feature: HEFZJCU01CCSKM.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccgggctgctacttcgatctctggggccgtggcaccctggtcactgtcttctcagcctccaccaagggcccatcggtcttccccctggcaccctcctccaagagcacctcgtgggggcacaggcggccctggggctgccgtgtcaaggactactttcctatacgta

SEQ ID NO: 531990 - DNA, 498 bp, Homo sapiens; identical to SEQ ID NO: 470496
  misc_feature: HEFZJCU01BEWSQ.11.71.G05.1.454.heavy.3.raw

SEQ ID NO: 531991 - DNA, 528 bp, Homo sapiens
  misc_feature: HEFZJCU01BW08T.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggccgcctgctccaggagcacctccgagacgcacagcggccctcgggccg

SEQ ID NO: 531992 - DNA, 489 bp, Homo sapiens
  misc_feature: HEFZJCU01D5KOQ.40.17.B06.1.454.heavy.3.raw
tctagcgactcacgaccggtgctcgatttagtcgatagtgaagggggcagagcctgctgaattctggctgactagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctggtaatagtgttgcttggaactggatcaggcagtccccatggagaggccttgagtggctgggaaggacatcctacaggtccgacaggtccgagtggttaaatgaatttgctagttttgtggaaagtcgaataaccatcaatgcagacacatccaagaaccagttctccctgcacctaaactctatgactcccgaggacgcggctgtttattactgtgcaagaggacgaattgcatactatg

SEQ ID NO: 531993 - DNA, 495 bp, Homo sapiens
  misc_feature: HEFZJCU01CIW2H.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaaccatggagtttgggctgagttgggttttcctcgttgctcttttaagaggtgtccactgtcagctgcttctagttgagtcggggggaggcgtggcccagcctggggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggcgattcatcatctccagagacaactccaacaacacactggatctccaaatgaacagcctgagagtcgaggacacggccgtatatttatttgtcgtcccttgactttactta

SEQ ID NO: 531994 - DNA, 535 bp, Homo sapiens
  misc_feature: HEFZJCU01CFQ2A.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgtacccgtggggccggggaacccgtggtcaccgtcctccccacccctccaacccg

SEQ ID NO: 531995 - DNA, 522 bp, Homo sapiens
  misc_feature: HEFZJCU01DD3ES.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaccaagggcccatcggtcttcccctggcaccctcctccaagagcacctctgggggcacagcgcctggctgcctggtcaaggactacttcccatactcgta

SEQ ID NO: 531996 - DNA, 523 bp, Homo sapiens
  misc_feature: HEFZJCU01CTJT9.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccgaggggacaagtggtcaccgtctcttcagt

SEQ ID NO: 531997 - DNA, 521 bp, Homo sapiens
  misc_feature: HEFZJCU01C65UL.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtggagggccgattcagcatctccagagacaacggcaacgagtatactgtatctggtaaatgaacaatctgagagtcgacgatacggctgtctatctattgtgttttcgtatgccgtttcggtccgcgggtacgttctggggccacgggtaacccg

SEQ ID NO: 531998 - DNA, 495 bp, Homo sapiens
  misc_feature: HEFZJCU01EFL1G.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctctttttaagaggtgtccagtgtcaggtgcagctggtggagtctgggggagcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagcgaggacacggctgtgtattactgtgtcagagatggaggggggtggtggatcc

SEQ ID NO: 531999 - DNA, 524 bp, Homo sapiens
  misc_feature: HEFZJCU01DYKL2.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattactgtgcgagagagtggggcccacggaacgttacgtacgctatggacgtctggggccaacggggaccg

SEQ ID NO: 532000 - DNA, 505 bp, Homo sapiens
  misc_feature: HEFZJCU01CY279.4.7.A07.1.454.heavy.3.raw
  modified_base (438)..(438): a, c, t, g, unknown or other
agcactgtagcacgaccggtgctcgatttagcacgtgtcgcaggggctgagagaggagcccagcccctgggattttcaggtgttttcatttggtgatcaggactgaacagagagaactcaccatggagtctgggctgagctgcctttttcttgtggctattttaaaaggtgtccagtgtgaggtgcagcgtggtggagtctgggggagcttggtacagcctgggggtccctgagactctcctgtgcagcctctggattcatctttagcagctatgccatgagctgggtccgccaggctccagggaagggctggaatgggtctcatctattagtgctactactggtggcacatacttcgcagactccgtgaaggccggttctccatctccagagacaattccaagaacacgctgtatctgcaattgaacagcctgaagngccgaggaccacgggccgtatacttacgtgtgacgaaagtatttcgggggaaattcgacccacgtac

SEQ ID NO: 532001 - DNA, 531 bp, Homo sapiens
  misc_feature: HEFZJCU01C1UHU.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcggtctgtcagtggattgactactgggccaggaacctggtcaccgtctcctcacgcctccaccaaggg

SEQ ID NO: 532002 - DNA, 502 bp, Homo sapiens
  misc_feature: HEFZJCU01D5UIQ.51.5.A05.1.454.heavy.3.raw
  modified_base (485)..(485): a, c, t, g, unknown or other
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtgggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtctgcactcgtgtcggccctaatttggtttaccggcacacaaatcaggnaagtcctacgacgtctg

SEQ ID NO: 532003 - DNA, 512 bp, Homo sapiens
  misc_feature: HEFZJCU01BUIBQ.19.17.B06.1.454.heavy.3.raw
tactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtctgggggaggcctggtcaagcctggggggtccctgcgactctcctgtgtggtctccggattcccattcagtcactatagtatgatgtgggcccgccaggctccgggagggctggaatggcttgcatcccttggttggagtggaattaatacacaccacgcagactcagtgaggggccggttcgaccatctccagagacaacgccaagagtacaatgtatttacaaatgaacagcctgagagccgaggatacggcctagtgtatttattgttgcgagactttccgagccgcacttac

SEQ ID NO: 532004 - DNA, 526 bp, Homo sapiens
  misc_feature: HEFZJCU01A3SU0.48.15.B04.1.454.heavy.3.raw
agtatacatacacgaccggtgctcgatttagacagtatatatccgcgggcacgaccggtgctcgatttagacagtatatatccgcgggcacgaccggtgctcgatttagacgcgatcgaagggtttgggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtcctgacactgtcctgcgcagcctctggattcaccttcaccacctttcgtatgcactttgtccgccaggctccaggcgaaggggctggagtgggtggctgttgtgtcaaatgatggacatgctgaatatgcagacttccgtggacgggggccgagttccgcctttctccagagacaatttccaaagacgcacgggttcatcctagctaaatggagccg

SEQ ID NO: 532005 - DNA, 510 bp, Homo sapiens
  misc_feature: HEFZJCU01AVCNW.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggggagcgactggttcgacccctggggccagggaaccctggtcaccgtctcctcagcctccaccaaggcccatcggtcttccccctggcaccctcctccaagagcacctctgggggcacagcggccctgggctgcctggtcaaggactacttcctacgtcgtat

SEQ ID NO: 532006 - DNA, 478 bp, Homo sapiens
  misc_feature: HEFZJCU01B1ETJ.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcgtctcccctggcaccctcctccagagcacctctggggcacagcgccctgggctgcctggtcaaggactacttccgtatctctcg

SEQ ID NO: 532007 - DNA, 519 bp, Homo sapiens
  misc_feature: HEFZJCU01ELLW1.51.31.C09.1.454.heavy.3.raw
  modified_base (512)..(512): a, c, t, g, unknown or other
cgatcgtatacacgaccggtgctcgatttagacgtctcatcaaggaaggaaggggagctctgagagaggagcccagccctgggattttcaggttgtttttcatgtggtgatcaggactgaacagagagaactcaccatggagtctgggctgacgtggctttttcttgtggctattttaaaaggtgtccagtgtgacgtgcagctggtggagtctggggggaggcttgatacagccgggggggtccctgagactctcatgtagaacctctggcttcatgtttagagtctatgacatgagttgggtccgccaggctccggggaagggctggagtgggtctcaatgatcagtgatggtggaacgaccacaaactacgccgactccgtgaagggccggtgcaccatctccagagacaattcgaaggacactttatatctgcaactcaacagactgaccacccgcggacacggccgtctactactgtgtgaaagaagacggaccgctggacgagganccgagaa

SEQ ID NO: 532008 - DNA, 491 bp, Homo sapiens
  misc_feature: HEFZJCU01BVS7R.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgatatctgaagacaccggcctattttattactggtgcgagagatgcagggccctcccactagtcggtttta

SEQ ID NO: 532009 - DNA, 504 bp, Homo sapiens
  misc_feature: HEFZJCU01EV392.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaagggcttgagtggatgggatgggtcaatcctaacagtggcggcagcggtctcacagaatatgcacagaagtttcagggcagggtctccatgaccgagggacagggccatcagaacagcctacatggagctgaaacagactgacagtctgaacgacacgggtccgtttaattattgttgtggtagagaggacccgatcgaccttcc

SEQ ID NO: 532010 - DNA, 516 bp, Homo sapiens
  misc_feature: HEFZJCU01BH1M5.4.19.B08.1.454.heavy.3.raw
  modified_base (408)..(408): a, c, t, g, unknown or other
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaagggggttggagtgggtggcaggcaatatcatatgatggaagtgaataaatattacatagagtccgtggaagggttcgattcaccatctccagagacaatacgnaagaacacactgtatctaggaatgaccacgcctggacgaggtggaacgacgacggttaggtttattactgttggcgcgggagtagacgggctcacttcgtacggatac

SEQ ID NO: 532011 - DNA, 503 bp, Homo sapiens
  misc_feature: HEFZJCU01CS3GM.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaactatgcacagactttcaggctgggtcacatgaccagcgacacatctagcaacacagtctacatggagttgaccagcctgaccgaccgacggccgtgttactttttgtgttcggagagtacttttcggactaataccgagacgtaccccgtgttcc

SEQ ID NO: 532012 - DNA, 540 bp, Homo sapiens
  misc_feature: HEFZJCU01CIYL3.48.40.D07.1.454.heavy.3.raw
agtatacatacacgaccggtgctcgatttagtgatagagcgtaacaacagaggggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactggggtccgccaagctccagggaaggggctggagtgggtctcaaacgtgaacgttgatggcgggatcacaaatacgcggactccgtgaaaggccgctcaccgtctccagagcaacggcgagaatactctgtatttgcagatgagaatctagagaggcgaggacaccgcgctttattatttgtacaacgttcgttttacttttctatggtgctcttacgaacgacatggactagttgggggtcggggaaccgtggt

SEQ ID NO: 532013 - DNA, 515 bp, Homo sapiens; identical to SEQ ID NO: 471562
  misc_feature: HEFZJCU01DEYGK.13.76.G10.1.454.heavy.3.raw

SEQ ID NO: 532014 - DNA, 515 bp, Homo sapiens
  misc_feature: HEFZJCU01DCEVV.12.25.C03.1.454.heavy.3.raw
atacgacgtacacgaccggtgctcgatttagtagtgtagatttgggtttggggacccaaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagacgaacacagtcaacatggagttgcggagcctgcgatctgacgacgcggccgtatattactgtgcgagagtacgtagcggctcgtcctttgctacgtggggcctgggaactcgtggtcacgtct

SEQ ID NO: 532015 - DNA, 538 bp, Homo sapiens
  misc_feature: HEFZJCU01EJTFV.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctcggattccccttcagtagttattggatgacttgggtccgccagactccagggaaggggctgggagtgggtggccaacataaagcaagatggaaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggatgtgtttattggggtccaggggagccgtggtctaccg

SEQ ID NO: 532016 - DNA, 532 bp, Homo sapiens
  misc_feature: HEFZJCU01AJ8YK.40.20.B09.1.454.heavy.3.raw
tctagcgactcacgaccggtgctcgatttagtgtagtgtgaagggggagagaggagccttagccctggattccaaggcctatccacttggtgatcagcactgagcaccgaggagtcaccatggaactggggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaaggagggactttgggagtactactacggtatggacgtcgtggggccaagggtaccc

SEQ ID NO: 532017 - DNA, 522 bp, Homo sapiens
  misc_feature: HEFZJCU01DT348.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgtcttttgatatctgggccaagggacaatggtcaccgtctcttcagcctccacgaaggcccatcggtccttcccctggccaccctcctccaagagccacctcgtcggggtcacgagccggtcccg

SEQ ID NO: 532018 - DNA, 516 bp, Homo sapiens
  misc_feature: HEFZJCU01CWM42.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattacctgtgcagagatcagtccggacgacgaaatgactacggtggtaaccttccagactactggggccagggaaccctgggtcaccggtctccctcagcctccaccaaggcccatcggtcttcccctgcaccctcctcc

SEQ ID NO: 532019 - DNA, 485 bp, Homo sapiens
  misc_feature: HEFZJCU01C9SKK.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacaagcctgagagctagaagacacggctgttgttttacttgtggcgagagagaa

SEQ ID NO: 532020 - DNA, 522 bp, Homo sapiens
  misc_feature: HEFZJCU01D0JBH.48.42.D09.1.454.heavy.3.raw
agtatacatacacgaccggtgctcgatttagacacatacgcagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgcccaagaaagtgttttatcccgtggggccagggaaccctgtcaccgtctcctcagcctccaccgaaggaccctacg

SEQ ID NO: 532021 - DNA, 508 bp, Homo sapiens
  misc_feature: HEFZJCU01DX7S6.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccaataaacacagcctacatggagttgaggagcctgacatctgacgacacggccgtctattactgtgcgagagtcccacgatccgggtgagcctacggcaggcggcctttgactttcgtc

SEQ ID NO: 532022 - DNA, 513 bp, Homo sapiens
  misc_feature: HEFZJCU01BD0BE.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcaggtattactggtggtggttataccacatactacgcagactccgtgaagggccggttcaccatctccagagacaattaccaagaacacactgtatctgacaaatgaacagcctgagagccgacgacacggccatatattactgtgacgaaagcaccggcagttagtccacccatactactttagactacgt

SEQ ID NO: 532023 - DNA, 517 bp, Homo sapiens
  misc_feature: HEFZJCU01DFRE9.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcgtcttcccctgcaccctcctccaacgagcacctctgggggcacagcggccctgggctgcctggtcaaggactacttcctagagacacg

SEQ ID NO: 532024 - DNA, 517 bp, Homo sapiens
  misc_feature: HEFZJCU01D4UOB.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgacttgcaatgaacaccctgcgagccgaggacacggcctatattactgtgcgagaactaaccgtcgccttggttattaccg

SEQ ID NO: 532025 - DNA, 371 bp, Homo sapiens; identical to SEQ ID NO: 444919
  misc_feature: HEFZJCU01AWCXK.3.1.A01.1.454.heavy.3.raw

SEQ ID NO: 532026 - DNA, 483 bp, Homo sapiens
  misc_feature: HEFZJCU01D59T5.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtattttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaggactacttccgtatctctcg

SEQ ID NO: 532027 - DNA, 502 bp, Homo sapiens
  misc_feature: HEFZJCU01BUE1D.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactgggtccgcaacagactacggtggcaactcctatgcttttgatatctggggccgagggac

SEQ ID NO: 532028 - DNA, 533 bp, Homo sapiens
  misc_feature: HEFZJCU01EPT0J.4.66.F11.1.454.heavy.3.raw
agcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctggggggtcccttagactcgtcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagatgattcaaaaagtacaactgtatctggaaatgaacagcctgagaatcgacgacacagccgtttattactgtcagaagagggcactatggtccctggggccagggaaccctgggtcaccgtctccgtcacgt

SEQ ID NO: 532029 - DNA, 520 bp, Homo sapiens
  misc_feature: HEFZJCU01A1FSX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagagtggggccacgaacgttactacgctatggacgtcgtggggaccaagggaccg

SEQ ID NO: 532030 - DNA, 506 bp, Homo sapiens
  misc_feature: HEFZJCU01BQHAN.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccaataacacagcctacatggagttgaggagcctgacatctgacgacacggccgtctattactgtgcgagagtcccagactccggtgagcctacggcagcggtcctttgactttcgtc

SEQ ID NO: 532031 - DNA, 531 bp, Homo sapiens
  misc_feature: HEFZJCU01A2CC2.11.85.H08.1.454.heavy.3.raw
  modified_base (505)..(505): a, c, t, g, unknown or other
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcaactcaagagtcgactttaccatatcactcgacacgtccaggaatcagttctccctgaaactgaggtccgtcattgtcgcggacacagccgtctattattgtgtcagagatccggcccataactggctcggcccctggggcccgggaaccctggtcaccgtctcctcagcctccaccaggcccancggtcttcccctggccaccctcctcc

SEQ ID NO: 532032 - DNA, 400 bp, Homo sapiens; identical to SEQ ID NO: 444452
  misc_feature: HEFZJCU01A18SN.47.24.C02.1.454.heavy.3.raw

SEQ ID NO: 532033 - DNA, 493 bp, Homo sapiens
  misc_feature: HEFZJCU01B6TV7.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctgactttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagtattggggaatgaccacgtc

SEQ ID NO: 532034 - DNA, 516 bp, Homo sapiens
  misc_feature: HEFZJCU01EXWHG.13.71.G05.1.454.heavy.3.raw
tcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatattctgcagatagaacagcctgggagccgaggacacggccgtttatcactgtgacgaaagatattgtaatagatggtagcgtgctactactactttttagacttac

SEQ ID NO: 532035 - DNA, 395 bp, Homo sapiens; identical to SEQ ID NO: 445227
  misc_feature: HEFZJCU01DFX11.47.46.E02.1.454.heavy.3.raw

SEQ ID NO: 532036 - DNA, 514 bp, Homo sapiens
  misc_feature: HEFZJCU01BE7VF.7.28.C06.1.454.heavy.3.raw
  modified_base (476)..(476): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatcctattactgtgcgaaactctcattccgttnatctagaatactggggccacgggaacctggtccgtccg

SEQ ID NO: 532037 - DNA, 542 bp, Homo sapiens
  misc_feature: HEFZJCU01EN3G2.48.40.D07.1.454.heavy.3.raw
agtatacatacacgaccggtgctcgatttagtgatagagcgtaacaacagaggggcccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcggatcacaaaatacgcggactccgtgaaaggccgcttcaccgtctccagagacaacggcgagaatactctgtatttgcagatgagaaatctgagaggcgaggacaccgcgctttattattgtacaacgttcgttttacttttctaatggtggctcttacgaacgacatgactagttggggtcgggaacccgtggtactaccg

SEQ ID NO: 532038 - DNA, 503 bp, Homo sapiens
  misc_feature: HEFZJCU01AXQKU.17.10.A10.1.454.heavy.3.raw
  modified_base (459)..(459): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttntgtcatcgtacaatttgataggctctatggactggtacttcgtc

SEQ ID NO: 532039 - DNA, 498 bp, Homo sapiens
  misc_feature: HEFZJCU01DOS3I.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctgggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgtctttgatatgtgggaccg

SEQ ID NO: 532040 - DNA, 362 bp, Homo sapiens; identical to SEQ ID NO: 444925
  misc_feature: HEFZJCU01AL2BK.49.25.C03.1.454.heavy.3.raw

SEQ ID NO: 532041 - DNA, 521 bp, Homo sapiens
  misc_feature: HEFZJCU01CSQ0B.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgagggccgattcagcatctccagagacaacggcaagagtatactgtatctaggaaatgaacaatctgagagtcgacgatacggctgtctatctattgtgttttcgattcgccgtttccggtccgcgggacttcgtggggccgagggtaaccccg

SEQ ID NO: 532042 - DNA, 534 bp, Homo sapiens
  misc_feature: HEFZJCU01AKKIB.49.31.C09.1.454.heavy.3.raw
  modified_base (449)..(449): a, c, t, g, unknown or other
agtcgagagacacgaccggtgctcgatttagacgtctcatcaaggaaggaaggggtctgagagaggagcccagccctgggattttcaggtgttttcatttggtgatcaggactgaacagagagaactcaccatggagtttgggctgagctggctttttcttgtggcttttttaaaaggtgtccagtgtgaggtggagctgttggagtctgggggaggcttggtacaatttggggggtccctgggactctcctgtgcagcctctggattcactttcagcagctatggcatgaactgggtccgccaggctccagaaaagggctggagtgggtctcaggtattagtggtagtggtggtatcacatcctacgtagactccgtgaagggccggttcaccatcctccagagacaattccaagaacaaactttatttgcacatggaaagcctgagngccgaggacacggaccatatattactgtgcgagacgtagggaactacttaggaggtgtcttttgatgtcgtggggccgaagggac

SEQ ID NO: 532043 - DNA, 514 bp, Homo sapiens
  misc_feature: HEFZJCU01AGVKH.49.81.H04.1.454.heavy.3.raw
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaactttatcacgggagtacgaagggtgacccccgtccg

SEQ ID NO: 532044 - DNA, 422 bp, Homo sapiens
  misc_feature: HEFZJCU01AXQP9.40.81.H04.1.454.heavy.3.raw
tctagcgactcacgaccggtgctcgatttagtagtgtagattcgcgggggccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggcctcggtgaaggtctcctgcaagatttctggaaacaccctgagcaactactacatacactggatgcggcaggcccctggacagggggtttgagtggatgggggtggatcaaccctaccagaggtggcacaaagtatcgacagaactttcagggcagggtcaccatgacctgggacgcgtccatcagcacagtctacatggat

SEQ ID NO: 532045 - DNA, 528 bp, Homo sapiens
  misc_feature: HEFZJCU01BWTWU.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaccaagtggtcctgacaatgaccaacgtgaagcctgcggacacggccacatattatgtgcacaccgacgctataccgccagctgggaaatcgacaactggttcgaccccgtggggccacgggacccttagtcctaccgtcgtccctcacgcctcccaccgaacgggccctacg

SEQ ID NO: 532046 - DNA, 541 bp, Homo sapiens
  misc_feature: HEFZJCU01EQWXC.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcccggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaaggacacaggcgtgtattactagtaccacagagtgggccagatgacaaagtggccgcgacgagttcgacttacgtgggggaccc

SEQ ID NO: 532047 - DNA, 527 bp, Homo sapiens
  misc_feature: HEFZJCU01BKFEA.16.86.H09.1.454.heavy.3.raw
  modified_base (497)..(497): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctcgatagcagtggctggtccactaggtttgactactggggccaggggaancgtttggtctaccgtctcctcagcctaccc

SEQ ID NO: 532048 - DNA, 483 bp, Homo sapiens
  misc_feature: HEFZJCU01BKBHZ.2.33.C11.1.454.heavy.3.raw
acgctcgacacacgaccggtgctcgatttagagtgagctcgttgggtttgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttcccctggcgccctgctccaggagcacctccgagagcacagcggccctggctgcctggtcaggactacttcctgtcgagcgt

SEQ ID NO: 532049 - DNA, 521 bp, Homo sapiens
  misc_feature: HEFZJCU01AUA4B.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacgaattctggtaccacatactactccgaccccgtgaagggccgattaaccatctccagagacgattccgagaacacggtgtatcttcaatgaacaacctgagagccgacgacacggccgtttattacgtgtcgcgagagattcgagtggttcggggtacctcgaccctcggttctacttcgtatc

SEQ ID NO: 532050 - DNA, 532 bp, Homo sapiens
  misc_feature: HEFZJCU01BTTBT.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccgagggaagcgttggctttttaccgcttcctcacgcctacccg

SEQ ID NO: 532051 - DNA, 517 bp, Homo sapiens
  misc_feature: HEFZJCU01CB9CQ.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatcgtgagcgggactggacctacgtgacgacgacggccagttcgtattacttagtggaaacgagtacgttggtggcgtaccggcggggctgaccgactcggggga

SEQ ID NO: 532052 - DNA, 515 bp, Homo sapiens
  misc_feature: HEFZJCU01A3I1I.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacgagggctccagggcagactcaccatgaccacagacacatcagcgaacacagtcaacatggagttgcggagcctgcgatctgacgacgcggccgtatattactgtgtcgagagtacgtagcggctcgtcctttgactacgtggggctgggaactcgtggtcaccgtct

SEQ ID NO: 532053 - DNA, 393 bp, Homo sapiens
  misc_feature: HEFZJCU01D0DAY.49.46.E02.1.454.heavy.3.raw
agtcgagagacacgaccggtgctcgatttagactcatctacagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttcccctggcaccctcctcccaagagcacctctgggggcacagcggccctgggctgcctggtcaaggactacttcctctctcgact

SEQ ID NO: 532054 - DNA, 498 bp, Homo sapiens
  misc_feature: HEFZJCU01BFFTV.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctggggaggtccctgagactctcctgtacagcctctggcttcaccttcattacctatggcatgcactgggtccgccagactccaggcagggggctgggagtggggtggcagtttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgacgtacggggg

SEQ ID NO: 532055 - DNA, 498 bp, Homo sapiens
  misc_feature: HEFZJCU01CPU57.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaaggcccatcggtcttcccctggcaccctcctccaagagcacctctgggggcacagccggccctgggctgcctggtcaaggactacttcctcgtacgcact

SEQ ID NO: 532056 - DNA, 518 bp, Homo sapiens
  misc_feature: HEFZJCU01A6BOF.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggcccgtgtattactgtgcagagatggggcccagaacgttactacgctatggacgtctggggccaagggaccg

SEQ ID NO: 532057 - DNA, 526 bp, Homo sapiens
  misc_feature: HEFZJCU01EGWH9.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaagactgcacagaagtttcagggcagggtcaccatgaccagggacaagtaccaccaacacagcctacatggaactaaggggactgacaatctgacgacacggccatgtattattggtgcggagagaaaattgttaaggtacttgctttggggtcccgttggggcccggggaacccggggtcgattccg

SEQ ID NO: 532058 - DNA, 539 bp, Homo sapiens
  misc_feature: HEFZJCU01DGK1B.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgttccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgttgcgaaggcagttcgtggaactagttatgggttggggggtaggttggggtttttttttcgtttacttacgggt

SEQ ID NO: 532059 - DNA, 509 bp, Homo sapiens
  misc_feature: HEFZJCU01CGB2J.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagtttgaggagcctgacatctagacgacacggcgttctattactgtgcgagagtcccacgatcccggtagagcctacggcaggcggctttgacttcgtc

SEQ ID NO: 532060 - DNA, 538 bp, Homo sapiens
  misc_feature: HEFZJCU01DBNBX.17.28.C06.1.454.heavy.3.raw
  modified_base (400)..(400): a, c, t, g, unknown or other
  modified_base (477)..(477): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggcctggagtgggtggccaacataaagcaagatggaactgccgagttttacgtggactctgtgaagggccgtttcaccatcnccagagacaacgccaagaattcactgtatctacaactgaacagcctgacgagtcgcagaccacggccgtgtattacngtagcgagatgtggaaaaagtaatggctgtgtttattggggccagggagccctggtcaccg

SEQ ID NO: 532061 - DNA, 527 bp, Homo sapiens
  misc_feature: HEFZJCU01CSA4A.47.78.H01.1.454.heavy.3.raw
  modified_base (472)..(472): a, c, t, g, unknown or other
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatatctaacaaatggatagcctgaaaatcgaggatacaggtntttattactgttccaactagggaatggcggtttctcgtcggggccggaggggact

SEQ ID NO: 532062 - DNA, 514 bp, Homo sapiens
  misc_feature: HEFZJCU01DX9T4.9.12.B01.1.454.heavy.3.raw
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaagggctggagtgggtctcagttatttatagcggtggtaacacatactacgcagactccgtgaagggcagattcaccatctccagagacaattccaggaacacgctgtatcttcaaatgaacagcctgagagtcgaggacacgggctgtatattactgtgcgagagatggtgtacgtcttttgatatcgtggggccgaaggga

SEQ ID NO: 532063 - DNA, 399 bp, Homo sapiens
  misc_feature: HEFZJCU01EG6MD.52.62.F07.1.454.heavy.3.raw
cgcagtacgacacgaccggtgctcgatttagtagtcgcataaagggaaaggggctggagtgggtggcctttatatcatatgatggaactcagaaaaatatgcagattccctgaggggccgactcaccatctccagagacaattccaagagcacactgtttctgcaaatgaacagcctgagacctgaggacacggctgtctactactgtgcgaggccgccaacaccctacggtgactacgactactacttcgcccactggggccaggggagtctggtcaccgtctcttcagcctccaccaagggcccatcggtcttccccctggcaccctcctccaagagcacctctgggggcacagcggccctgggctgcctggtcaaggactacttcctatacgatcg

SEQ ID NO: 532064 - DNA, 513 bp, Homo sapiens
  misc_feature: HEFZJCU01A0KRP.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccccgtggccgccctcgctccaggacgcaccctccgagagcacagccgggcccgtcgggcgtcgccgtcggtcgaaggacttaccg

SEQ ID NO: 532065 - DNA, 511 bp, Homo sapiens
  misc_feature: HEFZJCU01EXJ6R.10.28.C06.1.454.heavy.3.raw
catagtagtgcacgaccggtgctcgatttagagctcacgtattgggtttgggggagctctcagagaggtgccttagcccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatagaacagtctgagagccgaggacacggctctctattactgtgcgagacgaccccgaaaagtagggtactacg

SEQ ID NO: 532066 - DNA, 502 bp, Homo sapiens
  misc_feature: HEFZJCU01BACTW.12.2.A02.1.454.heavy.3.raw
  modified_base (431)..(431): a, c, t, g, unknown or other
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatgggatcagcgcttacaatggtaacacagactatgcacagaagttccaggacaggagtcaccatgaccacagacacatccacgagcacagcctaccatggagctgaggagcctggagatctgacganacgggccggtgtattacttgtgcgagtaggttttagtgatacttatttagtagtggtggtacctgccttac

SEQ ID NO: 532067 - DNA, 517 bp, Homo sapiens
  misc_feature: HEFZJCU01BZ8PH.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggggtggatcaaccctaccagaggtggcacaaagtatcgacagaactttcagggcagggtcaccatgacctggggacgcgtccatcagcacagtctacatggatctgagcggactgacctctgacgacgacggccatgtattacgtggtggaagagacggttgggtgggtctacccggcgggggctggaccacgtgggggcccg

SEQ ID NO: 532068 - DNA, 499 bp, Homo sapiens
  misc_feature: HEFZJCU01EMF35.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctccactacagtgcggcctccagagtcgagccctcatatccatagacacgtccaagaaccagttttccctgacgctgacgtctgtgacgccgcagacacggctgtctattattgtgcgagactagccttctgtaggtgggggtacttgcaacccggggatacctactccacctttcggc

SEQ ID NO: 532069 - DNA, 519 bp, Homo sapiens
  misc_feature: HEFZJCU01BWDHB.49.81.H04.1.454.heavy.3.raw
agtcgagagacacgaccggtgctcgatttagtagtgtagattcgcggggtctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagagtactatgcagactccgtgaagggccgaattcaccatctccagagacaattccaagaacaacgctatatttgcacatgaacagcctgagagctgaggacacggctattttattactgtgcgaacttaatcacggtaggacaagggtgacccccggtccacgttcc

SEQ ID NO: 532070 - DNA, 520 bp, Homo sapiens
  misc_feature: HEFZJCU01CWC1I.51.57.F02.1.454.heavy.3.raw
cgatcgtatacacgaccggtgctcgatttagctcgatatagttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatatttactcagacgccgtgaggggccgattcaccatctccagagacaattccgggaacacactgtctctgcaaatgaacagcctgagagctgaggacgaggctgtttattacttgtgtgcgatccgacctccactggtacgggggtagtttacttcctccgcaacgggt

SEQ ID NO: 532071 - DNA, 513 bp, Homo sapiens
  misc_feature: HEFZJCU01EZH1Z.10.34.D01.1.454.heavy.3.raw
catagtagtgcacgaccggtgctcgatttagatcgtctgtgttgggtttgggggggagaggagccccagccttgggattcccaagtgttttcagttcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctacaagagatgattacaaaaagtacgactgtatctgaacatgaacagcctaggaaaacggacggacacagccgtgtattaactgtgtccactcgaggaccgactagtttgtt

SEQ ID NO: 532072 - DNA, 488 bp, Homo sapiens
  misc_feature: HEFZJCU01BDTEF.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcggg

SEQ ID NO: 532073 - DNA, 522 bp, Homo sapiens; identical to SEQ ID NO: 472044
  misc_feature: HEFZJCU01ASZ0X.13.76.G10.1.454.heavy.3.raw

SEQ ID NO: 532074 - DNA, 502 bp, Homo sapiens
  misc_feature: HEFZJCU01B0G9F.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctcccagagacaattccaggcacacgctgtatctgcaaatgaacagcctgagagctgaggacacggctgtgtattactgtgacgaaagatttctaatagaggtgacctac

SEQ ID NO: 532075 - DNA, 417 bp, Homo sapiens
  misc_feature: HEFZJCU01CIAOA.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggtttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgagtcatccctttctctaatgtcactaagatacacacagagattccagggcagaatcacacttaccgcggacaaaatccacgggcaacagcgcagttggaa

SEQ ID NO: 532076 - DNA, 495 bp, Homo sapiens; identical to SEQ ID NO: 454812
  misc_feature: HEFZJCU01D466U.16.37.D04.1.454.heavy.3.raw

SEQ ID NO: 532077 - DNA, 494 bp, Homo sapiens
  misc_feature: HEFZJCU01DK7IV.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattacccgcggacgaatccaacgacccacacgccctacatagagctgcgcagcctgagatctgaaagacacggccatttattactgtgcgagagatgcagggcccctccccacactcggtttta

SEQ ID NO: 532078 - DNA, 504 bp, Homo sapiens
  misc_feature: HEFZJCU01EQ0YR.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactagtgacggaaagtatttactatagaggtgacgtac

SEQ ID NO: 532079 - DNA, 539 bp, Homo sapiens
  misc_feature: HEFZJCU01ATC39.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattacaaaagcacgctgtatctgacaatgaacagcctgagaaccgaggacacagccgtgtattactgtaccacactccctagaaagcgtcaactactactactacggtatggacctcgtgggaccg

SEQ ID NO: 532080 - DNA, 528 bp, Homo sapiens
  misc_feature: HEFZJCU01EZYHA.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgagttcaccatctccagagacaactctaagaacacgctgtttcttcaaatgaacagcctgagagccgatgacacggccgtgtattactgtgcgagagatggggcccacgaacgttactacgctatggacgtctggggccgaagggaccac

SEQ ID NO: 532081 - DNA, 506 bp, Homo sapiens; identical to SEQ ID NO: 454268
  misc_feature: HEFZJCU01A3AHP.10.38.D05.1.454.heavy.3.raw

SEQ ID NO: 532082 - DNA, 526 bp, Homo sapiens
  misc_feature: HEFZJCU01DWZYO.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgagttcaccatctccagagacaattccaagaacacgctgtttcttcaaatgaacagcctgagagccgatgacacggccgtgtattactgtgcgagagagtggggcccacggaaccgttactacgctatggacgtcgtggggccaagggacccg

SEQ ID NO: 532083 - DNA, 499 bp, Homo sapiens
  misc_feature: HEFZJCU01CEIWY.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaattatgcacaggagtttcggggcagggtcatcatgaccggggacacgtccatcgccacacttacatggaactgaccagtctgacatttgacgacacggccgtcgtattactgtgcgacagaagcggcggacacgaggttcgcttactggttcgagg

SEQ ID NO: 532084 - DNA, 505 bp, Homo sapiens
  misc_feature: HEFZJCU01DY5BF.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagactcactgtatctgcaaatgaacacgctgagagccgagggacacggctgtgtattactgttgcgagaggagctattatcgtcggtaaccccgact

SEQ ID NO: 532085 - DNA, 374 bp, Homo sapiens; identical to SEQ ID NO: 444502
  misc_feature: HEFZJCU01DH84B.9.14.B03.1.454.heavy.3.raw

SEQ ID NO: 532086 - DNA, 504 bp, Homo sapiens
  misc_feature: HEFZJCU01CMPI9.8.59.F04.1.454.heavy.3.raw
ctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagcctggggcctcagtcagagtctcctgcaaggcttctggatacgccttcggcgaccactatatacactggatgcgccaggcccctggacaagggcttgagtggatggcctggatctacccgaatagtggtggcacaaattatgcacgggagtttcagggcaggggtcaccgtgaccgagggacacgtccatcactacagtctatatgcatttgagcggcctcagatctgacgacacggccgtcttacttttcgtgtcgagggaccgaccgtcttttgacttggacgactcacta

SEQ ID NO: 532087 - DNA, 508 bp, Homo sapiens
  misc_feature: HEFZJCU01DPZJQ.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagtcttttgactacgtggggccagggaaccctggtcatcgtctcctcagcctccaccacgggcccatcggtcttcccctggccaccctcctccaagagcacctctgggggcacagcgccctgggctgcctggtcaaggactacttccgagtagtaca

SEQ ID NO: 532088 - DNA, 521 bp, Homo sapiens
  misc_feature: HEFZJCU01CLCWB.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcggggcccacgaaccgttactacgcttatggacgtcgtgggggtaccg

SEQ ID NO: 532089 - DNA, 541 bp, Homo sapiens
  misc_feature: HEFZJCU01C76VT.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaagggctggagtgggtctcagttattgaaatgatggtgacacaatctacgccgactccgtgaagggccgattcaccatctccagagacaattccaagaacacggtgaatcttcaaatgaacagcctgagaaccgaggacacggccggtatattattgtataggttatggtggtaattcgggcccctggggccagggaaccgtggtcaccgtctcctcagcctccaccaagggccctacg

SEQ ID NO: 532090 - DNA, 527 bp, Homo sapiens
  misc_feature: HEFZJCU01AUC7D.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtctttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactacgtggggccggggagccccggtcatcgtct

SEQ ID NO: 532091 - DNA, 493 bp, Homo sapiens
  misc_feature: HEFZJCU01D2OAQ.22.86.H09.1.454.heavy.3.raw
acatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatgggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacggg

SEQ ID NO: 532092 - DNA, 510 bp, Homo sapiens
  misc_feature: HEFZJCU01BWIFX.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagcgacgacacggccatatattactgtgcgaaagcaccggcagttagtcacccatactactttgactactggggaccg

SEQ ID NO: 532093 - DNA, 328 bp, Homo sapiens
  misc_feature: HEFZJCU01C684J.11.85.H08.1.454.heavy.3.raw
cgagagataccacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgggcacagcgaccctgggctgcctggtcaaggactacttccgtatctctcg

SEQ ID NO: 532094 - DNA, 521 bp, Homo sapiens
  misc_feature: HEFZJCU01EHYCB.12.33.C11.1.454.heavy.3.raw
  modified_base (508)..(508): a, c, t, g, unknown or other
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactatttanggtatggagtctc

SEQ ID NO: 532095 - DNA, 523 bp, Homo sapiens
  misc_feature: HEFZJCU01EOPY7.48.41.D08.1.454.heavy.3.raw
agtatacatacacgaccggtgctcgatttagtcacgcgagaaagggaaaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactggaggacatgccgtgtattcttgtgtgagacgaagtagtagctcgccccttcttggactacgtggggccaggggaacccctggtcaccgcctccc

SEQ ID NO: 532096 - DNA, 494 bp, Homo sapiens
  misc_feature: HEFZJCU01BDRQL.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggagtgggatatgtggcagctccaggtgccagccggccccttacg

SEQ ID NO: 532097 - DNA, 507 bp, Homo sapiens
  misc_feature: HEFZJCU01BBBY6.53.49.E05.1.454.heavy.3.raw
cgcgtatacacacgaccggtgctcgatttagagcgactagcaacacacaaagggggggagaggagcccagcactagaagtcggcggtgtttccattcggtgatcagcactgaacacagaggactcaccatggagtttgggctgaactgggttttcctcgttgctcttttaagaggtgtccagtgtcaggtacaactggtggagtctgggggaggcgtggtccagcctgggaggtccctgagactctcctgtgcagcctctggattccccttccatgtatttgccatgcattgggtccgccaggctccaggcaaggggctggagtgggtggcagttatatcctttgatggaagtaacaaatattatggagagtccatgaagggccgattcaccatctccagagacaattccaagaacatagtgtatctgcaaatgaacggcctgagaggtgacgacacggctgtgtattactgtgacgaaagataactccccgcctgagtacttttgg

SEQ ID NO: 532098 - DNA, 514 bp, Homo sapiens
  misc_feature: HEFZJCU01BBLXN.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctccaagagtcgactcaccatatccgtagacacgtccaagaaccagttctccctgaagctgagctctgtgaccgccgcagacacggctgtgtattactgtgcgagggggccggatattgttatagaaccacctgctatctgagcttggtcgactgcgtgggggccagggaccctggtacacccg

SEQ ID NO: 532099 - DNA, 534 bp, Homo sapiens
  misc_feature: HEFZJCU01ETD3J.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcggggtagactcccacggttgggtttttgattatatggggccgagggggacagccggtcaaccgtctccttc

SEQ ID NO: 532100 - DNA, 493 bp, Homo sapiens; identical to SEQ ID NO: 498487
  misc_feature: HEFZJCU01D0Z7F.14.25.C03.1.454.heavy.3.raw

SEQ ID NO: 532101 - DNA, 524 bp, Homo sapiens
  misc_feature: HEFZJCU01DXYE9.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttacctacgtctatggacgtctgggggccaaggggacccg

SEQ ID NO: 532102 - DNA, 541 bp, Homo sapiens
  misc_feature: HEFZJCU01CCOUA.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttatctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactacttgggggccaggggaaccctggtcaccgtctccctcagccctccaccaacgggcccc

SEQ ID NO: 532103 - DNA, 497 bp, Homo sapiens
  misc_feature: HEFZJCU01BTEAQ.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactggttggggagagatggaggtcgaatattgta

SEQ ID NO: 532104 - DNA, 395 bp, Homo sapiens; identical to SEQ ID NO: 461967
  misc_feature: HEFZJCU01D147N.47.46.E02.1.454.heavy.3.raw

SEQ ID NO: 532105 - DNA, 526 bp, Homo sapiens
  misc_feature: HEFZJCU01EWRWU.7.21.B10.1.454.heavy.3.raw
  modified_base (162)..(162): a, c, t, g, unknown or other
cgtgtctctacacgaccggtgctcgatttagtgtcgtcgcaaggagagagggggagctctgggagaggagcccagcactagaagtcggcggtgtttccattcggtgatcagcactgaacacagaggactcaccatggagtttgggctgaactgggttttccncgttgctcttttaagaggtgtccagtgtcaagtgcaactggtggagtctgggggaggcgtgggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtagtactactgttacgaagggaggggggaaccgaggcgggagttccgaagtacttccg

SEQ ID NO: 532106 - DNA, 508 bp, Homo sapiens
  misc_feature: HEFZJCU01EHV5D.14.55.E11.1.454.heavy.3.raw
cgtctagtaccacgaccggtgctcgatttagcactcgcacgttgggtttggggagctctgggagaggagcccagcactagaagtcggcggtgtttccattcggtgatcagcactgaacacagaggactcaccatggagtttggggctgagctgggtttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgttattactgtgtcagagatgggaggggggtggtgtacg

SEQ ID NO: 532107 - DNA, 505 bp, Homo sapiens
  misc_feature: HEFZJCU01EKVAY.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggcacacaaaatcagggcaagtcctacgacggtc

SEQ ID NO: 532108 - DNA, 315 bp, Homo sapiens; identical to SEQ ID NO: 444763
  misc_feature: HEFZJCU01BKA59.47.56.F01.1.454.heavy.3.raw

SEQ ID NO: 532109 - DNA, 514 bp, Homo sapiens
  misc_feature: HEFZJCU01ED859.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgaggccgaggacacggccgtctattattgtgtgagagtttatggcgatggctgggtggacagatcactggggccaac

SEQ ID NO: 532110 - DNA, 517 bp, Homo sapiens
  misc_feature: HEFZJCU01CS9P2.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgcctatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagaccggaggacgaccggaccacatattaactgtgcgaaagatacgtcgggctcggtccgtcggtccgggt

SEQ ID NO: 532111 - DNA, 581 bp, Homo sapiens
  misc_feature: HEFZJCU01EEV9S.13.76.G10.1.454.heavy.3.raw
tcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgcccacattctacgcagactccgtgaggggcccggttcaccatcctccagagacaattccaagaacacggtgtatcttcaaatgaacgacctgagagtcgaggacacggccgtctattactgtgcgaaagatgcagaggacgggcccccggtaaagtcggggggcccgttgggtgggaggggtttccgtttcgttttggtaaccttggccgttcggggggaccgacgggggtaaaccccg

SEQ ID NO: 532112 - DNA, 532 bp, Homo sapiens
  misc_feature: HEFZJCU01AUKYT.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggccggagtgggtctcagcaatcagtggttctagtggaagtacattcgacgccgtctccgtgaagggccggttctccatctccagagacaattccaagaacactctatttcttcaatggacagcctgaaagacgaagacacgggcgtgtattttgtgtgaagatacgaagtctatgatacccaatttgggtaggggccgtttcatgtcgtggggacc

SEQ ID NO: 532113 - DNA, 538 bp, Homo sapiens
  misc_feature: HEFZJCU01CLJVO.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtaggtccttacaatgaccaccatggaccctgtggacacagccacatatttctgtgcacactctataggagcacctggtagtctgccaaactggttcgaccctggggcccggaacccgtggtccaccgtctcctcacgcctcccaccaagggcccatcggtcttccccgtc

SEQ ID NO: 532114 - DNA, 523 bp, Homo sapiens
  misc_feature: HEFZJCU01EWJK0.48.8.A08.1.454.heavy.3.raw
agtatacatacacgaccggtgctcgatttagcatactctacagggggagtctccctcactgcccagctgggatctcagggcttcattttctgtcctccaccatcatggggtcaaccgccatcctcgccctcctcctggctgttctccaaggagtctgcgcggaagtgcgcctggtgcagtctggagcagtggtgaagaggcccggggagtctctaaagatctcctgtcagggttctgaaggcgactttgacaccttctgggtcgcctgggtgcgccagaggcccggtaaaggactagagtatatgggcgtcatctatcctggtgactccgataccatatatactccgtcgtttcaaggccaggtcaccatgtctgccgacaagtccaagactgtcgcctacctccactgggccaaactgacgtcctccgacagcgccacttattactcgtgcgaggggtaggctactacgtcttggggtcgagaggacaactggttcgaccctggggccagggaaccctggtc

SEQ ID NO: 532115 - DNA, 531 bp, Homo sapiens
  misc_feature: HEFZJCU01D208L.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcatcaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccgagggaaccctggtcaccgtctcctcagcctccaccaac

SEQ ID NO: 532116 - DNA, 524 bp, Homo sapiens
  misc_feature: HEFZJCU01CEIDK.3.17.B06.1.454.heavy.3.raw
  modified_base (430)..(430): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtcgaaaggcagattcaccatctcaagagatgattcagagaactcactttanctgcaatgaacagcctgagaaccgacgacacggccgtctattattggtgtcatagaccctaggatacaacgacggtaggtacctggtaatttcc

SEQ ID NO: 532117 - DNA, 517 bp, Homo sapiens
  misc_feature: HEFZJCU01DFHJW.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcatttgtgttttcgattgcctttcggtccggcgggacgttctggggccagggtaacccg

SEQ ID NO: 532118 - DNA, 538 bp, Homo sapiens
  misc_feature: HEFZJCU01B2P54.17.34.D01.1.454.heavy.3.raw
cgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggtcctcggtgagggtctcctgcaaggcttctggaggcaccttcagcgactatagtttcaattgggtgcggacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgagggagtaatttactataacactgctcctttttacaccttcccttcgtacttctaggggccatcggaaccccggtcaccgt

SEQ ID NO: 532119 - DNA, 507 bp, Homo sapiens; identical to SEQ ID NO: 526279
  misc_feature: HEFZJCU01ANAGJ.12.33.C11.1.454.heavy.3.raw

SEQ ID NO: 532120 - DNA, 529 bp, Homo sapiens
  misc_feature: HEFZJCU01A3SLA.11.85.H08.1.454.heavy.3.raw
  modified_base (520)..(520): a, c, t, g, unknown or other
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctgggggcccgggaaccctggtcaccgtctcctcagcctccaccaacggcccatcgtctcccctggcnccctcctcc

SEQ ID NO: 532121 - DNA, 543 bp, Homo sapiens
  misc_feature: HEFZJCU01AHPG7.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtcccgccagactccagggaaggggctggagtgggtggccaacataaagcaagatggaactgccgagttttacgtggactctgtgaagggtccgtttcaccatctccagagacaacgccaagaattcactgtatctacaactgaacagcctgagagtcgcagacacggccgtgtattactgtgcgagatgtaggaaaaagtatggctagttgtttagtgggggcctaggggacgccctgggtccaccggt

SEQ ID NO: 532122 - DNA, 507 bp, Homo sapiens
  misc_feature: HEFZJCU01AGCUO.51.71.G05.1.454.heavy.3.raw
cgatcgtatacacgaccggtgctcgatttagtgtcgtcgcaagagagaggggctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggtctttgatatctggggccaagggacaatggtcattgtctctttcagcctccaccaagggcccagtcggtcttcccctggccaccctcctccaagacg

SEQ ID NO: 532123 - DNA, 523 bp, Homo sapiens
  misc_feature: HEFZJCU01B46L5.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctgggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggttgacccctgggggccaggggaaccctggtcaccgtctcctcag

SEQ ID NO: 532124 - DNA, 540 bp, Homo sapiens
  misc_feature: HEFZJCU01BVAA1.52.14.B03.1.454.heavy.3.raw
cgcagtacgacacgaccggtgctcgatttagtgtgagtagttccgcggggctttctgagagtcatggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcactgtctctggtggctccatcagcagtagtgattactactggggctggatccgccagccccccagggaaggggctggagtggattgggagtgtcttttatagtggaaacacctactacaacccgtccctcaagagtcgagtcaccatatcagtagacacgtccaagagccagttctccctgaagctgcgtctctgacgccgcggacacggccgtttatactgtgcgagtaccccggaacctttttacgtatttttggagtgatactataccggtatggggccttttgactttctggggtccaggggaaccctggtctaccgtcctcctcaggt

SEQ ID NO: 532125 - DNA, 501 bp, Homo sapiens; identical to SEQ ID NO: 491798
  misc_feature: HEFZJCU01EDCYW.49.41.D08.1.454.heavy.3.raw

SEQ ID NO: 532126 - DNA, 429 bp, Homo sapiens; identical to SEQ ID NO: 447944
  misc_feature: HEFZJCU01A8JMR.4.37.D04.1.454.heavy.3.raw

SEQ ID NO: 532127 - DNA, 498 bp, Homo sapiens; identical to SEQ ID NO: 445952
  misc_feature: HEFZJCU01E0KOY.11.71.G05.1.454.heavy.3.raw

SEQ ID NO: 532128 - DNA, 486 bp, Homo sapiens
  misc_feature: HEFZJCU01CK1UK.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtcccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaaggcccatcggtcttcccctggcgccctgctccaggagcacctccgacgagcacagcggcccgtgggctgcctcggtcaagacgtacttcccactactatg

SEQ ID NO: 532129 - DNA, 521 bp, Homo sapiens
  misc_feature: HEFZJCU01D3HLO.40.12.B01.1.454.heavy.3.raw
tctagcgactcacgaccggtgctcgatttagtagtgtagattccgcggggagctctgggagaggagccccagccctgagattcccaggtgtttccattcagtgatcagcactgaacacagaggactcaccatggagttgggactgagctggattttccttttggctattttaaaaggtgtccagtgtgaagtgcaactggtggagtctgggggagacttggtacagcctggcaggtccctgagactctcctgtacagcctctggattcacctttggtgattatgccatgcactgggtccggcaagctccagggaagggcctggagtgggtctcaggtatgaattggaacagtgctagtatcggctatgcggactctgtgaggggccggttcaccgatctccagagacagcgccaagacgttccctgtacctgcaaatgaacagtctgagaattgaggacacggccttgtattattgtgcgaaggggactatagggttcggggaggggtccttccgactacg

SEQ ID NO: 532130 - DNA, 509 bp, Homo sapiens
  misc_feature: HEFZJCU01CJBV9.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctgggccaagggaccacggtcatcgtctccgcagcctccaccaaggcccatcggtcttcccctggcaccctcctccaagagcacctctcgggggcacagcgccctgggctgcctgtcaaggactacttccgagtgcgtct

SEQ ID NO: 532131 - DNA, 517 bp, Homo sapiens
  misc_feature: HEFZJCU01DJLXH.49.6.A06.1.454.heavy.3.raw
  modified_base (434)..(434): a, c, t, g, unknown or other
agtcgagagacacgaccggtgctcgatttagatctactgacaggggagctctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctgggagtgggtctcaactattagcggtattggtactaccacatactacgcagactccgtgaagggccgcttcaccatctccagagacaattccaagaacatggtgtttctgtcaatgancagcctgagagcgaggacgacggccgtatattactgtgacgaaagttcgcgtcgctaggtactatttgactacgtggggaccg

SEQ ID NO: 532132 - DNA, 530 bp, Homo sapiens
  misc_feature: HEFZJCU01BQRH9.40.55.E11.1.454.heavy.3.raw
tctagcgactcacgaccggtgctcgatttagcactcgcacgttgggtttgggggctttctgagagtcatggatctcatgtgcaagaaaatgaagcacctgtggttcttcctcctgctggtggcggctcccagatgggtcctgtcccagttgcagttgcaggagtcgggcccaggactggtgaagacttcggagaccctgtccctcacgtgcactgtctctggtggctccatccgcaatcgtcgattctattggggctgggtccgccggcccccagggaaggggctggagtggattgcgagcatatattatgatgagagcgccctctacaacccccccctctacaacccctccctcaacgagtcgggtcaccactatctatagacacgtccaacagtcaattctccctggacttgacctctgtgaccgccgcagacacggctgtatattcctgtgcgacccacggaggggatgggccccaaatcctgccttactttgacctacgtggggccaagggaaccttggtcaccgt

SEQ ID NO: 532133 - DNA, 498 bp, Homo sapiens
  misc_feature: HEFZJCU01D4SFB.14.25.C03.1.454.heavy.3.raw
cgtctagtaccacgaccggtgctcgatttagtagtgtagatttgggtttgggtgcccaagctgctggagggcacggtcaccacgctgctgagggagtagagtcctgaggactgtaggacagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattccaccatctccagagacaattccaagaacacgcagtatctgcaaatgaacagcctgagagctgaggacacgggctgtgtattactgtgggagagatggagggtcgattattgtagtggtggtagctgctataactggatcgacccctggggcctgggaaccctggtcaccgtctcctcagcctccaccaaggcccatcggtccttccccctgg

SEQ ID NO: 532134 - DNA, 500 bp, Homo sapiens
  misc_feature: HEFZJCU01AXXCQ.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgctaaggaacagacataatgactcgtccccggtactttacg

SEQ ID NO: 532135 - DNA, 530 bp, Homo sapiens
  misc_feature: HEFZJCU01EQ0MX.48.53.E09.1.454.heavy.3.raw
  modified_base (352)..(352): a, c, t, g, unknown or other
agtatacatacacgaccggtgctcgatttagagagagtgtgttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgcttgtctctggaacttctatcaagggtagcagcttctactggggctggatccgccagcccccaggaaaggggctacaatgggttggaaatgtcaattctatgggcgctccactacaatccggccctccagagtcgagccctnatatccatagacacgtccaacaaccagtttccctgacgctgacgtctgtgaccgcgcagacacggctgtctattattgtgcgagactaggcttctgtagtggtgtacttgtcaacccgggtatactactccaacttcggcttggaccatcctggggaccaagggacctcggtcgtccc

SEQ ID NO: 532136 - DNA, 538 bp, Homo sapiens
  misc_feature: HEFZJCU01B9ERU.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagacctgacatctgacgacacggccgtctattactgtgcgagacgtcccacgactccggtgacggtccctacggccgaggccgggtccttttcggaaccttttcgtcgggggtccgaagggggaccg

SEQ ID NO: 532137 - DNA, 505 bp, Homo sapiens
  misc_feature: HEFZJCU01CCOQG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctaccataaacacagcctacatggagttgaggagcctgacatctgacgacacggccgtctattactgtgcgagagtcccacgatccggtgacgcctacggcagcggcctttgacttctc

SEQ ID NO: 532138 - DNA, 512 bp, Homo sapiens
  misc_feature: HEFZJCU01CTTX9.17.31.C09.1.454.heavy.3.raw
cgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacacccgccatatattactgtgcgagtccgttatcgccgcagatcactactactactacggtctaggacgtctc

SEQ ID NO: 532139 - DNA, 516 bp, Homo sapiens
  misc_feature: HEFZJCU01C2SKC.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtcccgccaagctcccaggcaaggggattggagtgggtggcagttgtttcatctgagggcagtgttcaatggtatgcagactccgtgaagggccgattacaccatctccagagacaattccaggaacacaatgtatttggaatgaacagctaagtcctgaggacacgggtgtatactactgtacgaaggagggggaaccaggcggagtccaagtactcg

SEQ ID NO: 532140 - DNA, 517 bp, Homo sapiens
  misc_feature: HEFZJCU01D3N5C.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttacccatgacccacgaactcctccataaacacagcctacatggaggttgaggagcctgacatctgacgacacggccgtctattactgtgcgagacgtcccacgatccggtgagcctacggcacggcggcctttggactttctcggggccagggacg

SEQ ID NO: 532141 - DNA, 534 bp, Homo sapiens
  misc_feature: HEFZJCU01BNH6S.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcgggcccctggggcccgggaaccctggtcaccgtctcctccagcctccaccaaggcccatcggtcttccccctcggccaccctcctcc

SEQ ID NO: 532142 - DNA, 518 bp, Homo sapiens
  misc_feature: HEFZJCU01C8YI4.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtggggttggccgttctagagacacaacctaacagtgacaccgcacaatacgccgcgtctgtgaaaggcagattcaccatctcaagagatgattcagagaactcactttatctgcaaatgaacagcctgagaaccgacgacacggccgtctattattgtgtcatacgacctaggatacaacgacggtcggtacctggt

SEQ ID NO: 532143 - DNA, 386 bp, Homo sapiens
  misc_feature: HEFZJCU01BMZJS.18.60.F05.1.454.heavy.3.raw
  modified_base (172)..(172): a, c, t, g, unknown or other
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctntgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctccgagagcgacagcggccctgggctgcctggtcaaggatacttcccatactcgta

SEQ ID NO: 532144 - DNA, 510 bp, Homo sapiens
  misc_feature: HEFZJCU01CSYIG.15.8.A08.1.454.heavy.3.raw
tctacgtagccacgaccggtgctcgatttagcatactctacagggtcttcgtggctcacgtccaccaccacgcatgtgacctcaggggtccctgagactctcctgtgccgcctctggagcagagtctgaattcaccttcatgcactttgccatgagctgggtccgccaggctccggggaaggggctggagtgcgtcgcatgtataactaaaagtggagacatcacactctacgcagactccgtgaagggccgcttcaccatctccagagacaactccaagaacacgctgtccctggagatgaacagcctgagagccgaggacacggccatttattactgtgcgaaagatagttcggggagtaattatcgagaatactattttgactcctggggccagggagccctggtcaccgtctcctcagcctccaccaagggcccatcggtcttccccctggcaccctcctccagagcacctcctgggggcacagcggccctgggctgcctggtcaa

SEQ ID NO: 532145 - DNA, 559 bp, Homo sapiens
  misc_feature: HEFZJCU01C73HT.17.28.C06.1.454.heavy.3.raw
  modified_base (357)..(357): a, c, t, g, unknown or other
cgtagactagcacgaccggtgctcgatttagagctcacgtattgggtttggggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgnggactctgtgaaggtccgttcaccatctcagagacaacgccaagaattcactgtatctacaactgaacagcctgagagtcgcagacacggccgtgtattactgtgcgagatgtaggaaaaagtaatgggcttggtgttttagttgggggccctaggggacgtacccgtgggtccaacccggtcctcctacacgcctaccccg

SEQ ID NO: 532146 - DNA, 531 bp, Homo sapiens
  misc_feature: HEFZJCU01CQ7NW.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaaagggccgattaacccatctccagagacgattccgagaacacggtgtatcttcaatgaacaacctgagagccgacgacacggccgtttattactgtgcgagagagttcgagtggttcgggggtacctccacccgtggttctactttcgatctcgtggggtcc

SEQ ID NO: 532147 - DNA, 537 bp, Homo sapiens
  misc_feature: HEFZJCU01APUC8.12.12.B01.1.454.heavy.3.raw
atacgacgtacacgaccggtgctcgatttagtagtgtagattccgcgggggcgtttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaactactttttttgacttattggggccagggaatcctggtcaccgtcgcctcagcctccaccaagggcccatcggtccttcccccg

SEQ ID NO: 532148 - DNA, 518 bp, Homo sapiens
  misc_feature: HEFZJCU01AS9MZ.51.26.C04.1.454.heavy.3.raw
cgatcgtatacacgaccggtgctcgatttagtctagcgactttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacgagggctgtttattactgtgtgcgatccgacctcactggtacggggagttacttcctccgcaacggtatac

SEQ ID NO: 532149 - DNA, 516 bp, Homo sapiens
  misc_feature: HEFZJCU01BF0HL.17.25.C03.1.454.heavy.3.raw
  modified_base (499)..(499): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagccctacatggagttgaggagcctgacatctgacgacacggccgtctattactgtgcgagagtcccacgatccggtgagccctacggcagcggtcctttgacttcgngggggccaggggtaccg

SEQ ID NO: 532150 - DNA, 533 bp, Homo sapiens
  misc_feature: HEFZJCU01B4GPF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacccttttatcctgcaaatagacagcctgagaccagacgacacggctgtctattattgcgcgacgagaggacacacgaacctactggccaatactatgggggtcttgttctggggccaggggaccctggtcatcgtctccccgagccctccaccgaagggcccagtccggtcttccccctggccg

SEQ ID NO: 532151 - DNA, 535 bp, Homo sapiens
  misc_feature: HEFZJCU01DYS9L.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaccctggtcaccgtctcctcagcctccaccaacgggcccatcggtcttcccctcgcaccctcctccaagacg

SEQ ID NO: 532152 - DNA, 494 bp, Homo sapiens
  misc_feature: HEFZJCU01BLOAY.51.64.F09.1.454.heavy.3.raw
cgatcgtatacacgaccggtgctcgatttagcgcgtatacaaggggctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgcgaaacggaatgagtggaactagggtt

SEQ ID NO: 532153 - DNA, 525 bp, Homo sapiens
  misc_feature: HEFZJCU01EM4UD.16.27.C05.1.454.heavy.3.raw
  modified_base (519)..(519): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgttctccaagtgattgatctgagaagtgaggacacggctgtttattactgtgcgcggtggctgaccgctcttgactacgtggggccggggagccccggtcntcgtct

SEQ ID NO: 532154 - DNA, 518 bp, Homo sapiens
  misc_feature: HEFZJCU01CJGDT.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcgggagcctgcgatctgacgacgcggccgtatattactgtgcgagagtacgtagcggctcgtcctttagcttactggggcctgggaactcgtggtcaccgtctccg

SEQ ID NO: 532155 - DNA, 509 bp, Homo sapiens
  misc_feature: HEFZJCU01D6MKB.2.49.E05.1.454.heavy.3.raw
acgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctattttaaaaggtgtccagtgcgaggtgctgctggtggagtccgggggaggcttagttcagcctggggggtccctgagactctcctgtgcagcctctggattcaccttcagtcgctactggatgcactggttccgccaagttccagggaaggggctggagtgggtctcacgcattgatccatctgggaataggattaactacgcggcctccgtgaggggccgattcaccatctccagagacaacgccaggaacactctgtatctggaaatgagcagtctcagaggcgaggacacggctgtttattactgcacaagtgacgcgttcggggagactgactacgtggggccgagggc

SEQ ID NO: 532156 - DNA, 513 bp, Homo sapiens; identical to SEQ ID NO: 446452
  misc_feature: HEFZJCU01EV0EH.17.33.C11.1.454.heavy.3.raw

SEQ ID NO: 532157 - DNA, 515 bp, Homo sapiens
  misc_feature: HEFZJCU01BJ1C6.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggggccgattcaccatctccagagacaattccaagaacacgctgtttcttcaaatgaacagcctgagagccgatgacacggccgtgtattactgtgcgagagatggggcccacgaacgttactacgctatggacgtcgtggggccg

SEQ ID NO: 532158 - DNA, 526 bp, Homo sapiens
  misc_feature: HEFZJCU01DXN26.13.76.G10.1.454.heavy.3.raw
  modified_base (281)..(281): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtactggaggaggcttgatccagcctggggggtccctgagactctcctgtgcagcctctgggttcaccgtcagtcacacctacatganctgggtccgccaggctccagggaaggggctggagtgcgtctcttttatttatagtagtggtagtacatactccgcagactccgtgaggggccgattcaccatctccagagacaattccaagaacacgctgttcttcaaatgaaacagcctgagagccgatgacacggccgtgtattactgtgcgagagatgggggcccgacgaaccgttactaacgctatggacgtctgggggccaagggacccg

SEQ ID NO: 532159 - DNA, 503 bp, Homo sapiens
  misc_feature: HEFZJCU01DCMBA.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtggtggggtgggtcagcggctttgacggtaaggcacagtatgcaccgaagatgaagggcagagtcacgattaccacggaccacccccacgaacacagtctacatgcaactgacgagcctgagagctgacgacacggccgtctattactgtgcgagaatgttttctgtctatcgtactaatttgattaggctctatgactggacttctc

SEQ ID NO: 532160 - DNA, 361 bp, Homo sapiens
  misc_feature: HEFZJCU01C30Z3.22.85.H08.1.454.heavy.3.raw
acatacgcgtcacgaccggtgctcgatttagtatcactcagtcgcgggaggacgctgaccacacggtacgtgctgttgtactgctcctccgcggctttgtcttggcattatgcacctccacgccgtccacgtaccagttgaacttgacctcagggtcttcgtggctcacgtccaccaccacgcatgtcgacctcaggggtccggggagatcatgagggtgttccttggggttttggggggagaggagtcccaagcaactggggatccgaggtcgtttccattcggtgatcctagcactggaactaccgaggagacgttcaccatggtagttttggcctagacgcgttgggttttccttgtt

SEQ ID NO: 532161 - DNA, 501 bp, Homo sapiens
  misc_feature: HEFZJCU01CK94L.11.73.G07.1.454.heavy.3.raw
  modified_base (472)..(472): a, c, t, g, unknown or other
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgngatcgacagaaaaagcggtaggcctagtc

SEQ ID NO: 532162 - DNA, 542 bp, Homo sapiens
  misc_feature: HEFZJCU01DXGSC.40.57.F02.1.454.heavy.3.raw
tctagcgactcacgaccggtgctcgatttagctcgatatagttgggtttggggagctctgagagaggagcccagccctgggactttcaggtgttttcatttggtgatcaggactgaacagagagacctcaccatggactttgggctgaggtggctttttcttgtggctcttttaaaaggtgtccagtgtgaggtgcagttattggagtcggggggaggcttaatacagccgggggggtccctggagactcgcctgtacagcctctggactcacctttagaaatgatgccttgagctgggtccgccaggctgcagggaaggggctggaatgggtctctattattagtggtaggacagatagtcgaaactacgctgactccgtgaagggccgcttcaccatctccagagacgtttccaacaacacgatcttctggagatgaatagcctgagagccgaggacacgggccaaatacttactgtgacgtaaaagaccctactattgtagtggtgaagttgaactactactttgattcctggggtccg

SEQ ID NO: 532163 - DNA, 515 bp, Homo sapiens
  misc_feature: HEFZJCU01EHOYS.2.16.B05.1.454.heavy.3.raw
  modified_base (472)..(472): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctcagagacaacgccaagaactcactgtatctgcaaatgaacagacctaagacccgaggacacggctgtgtattacngtgcgagagaccgctacgtgggggcccgggagcccctggtacc

SEQ ID NO: 532164 - DNA, 529 bp, Homo sapiens
  misc_feature: HEFZJCU01CKVO1.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttggctgagctgggttttccttgttgctatttcaaaaggtgtccactgtgaggagcagttggtggagactggaggaagcctgatccagccgggggggtccctaagagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctccgtcaatggctttcattactggggccacgggtaacccg

SEQ ID NO: 532165 - DNA, 504 bp, Homo sapiens
  misc_feature: HEFZJCU01AR2TI.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccatatggaccctgtggacacagccacatattactgttcacgctctatggttcggggagttattagtccctactttgactactggggccagggaactctggtcaccgtctccgcagcctccacc

SEQ ID NO: 532166 - DNA, 493 bp, Homo sapiens
  misc_feature: HEFZJCU01CJJZW.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacgacggctgtgtattactgtgcgaagtatttctat

SEQ ID NO: 532167 - DNA, 547 bp, Homo sapiens
  misc_feature: HEFZJCU01DH6TF.14.57.F02.1.454.heavy.3.raw
cgtctagtaccacgaccggtgctcgatttagctcgatatagttgggtttgggtgcccaagctgctggagggcacggtcaccacgctgctgagggaggcttggtacagccgggggggtcccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacaactctatttcttcaaatggacagcctgaaagacgaagacacgggcgtgtatttttgtgtgaaagatacgaagtctatgatacccaatttgggaggggcctttcatgtctggggccagggacgctggtcaccgtctcttcagcctccaccaagggcccatcggtcttcccctggcaccctcctccaagacgcacctcgtgggggccacacgccggcccgtcgggctggccctggtaccgaagggtaa

SEQ ID NO: 532168 - DNA, 515 bp, Homo sapiens
  misc_feature: HEFZJCU01DJMY0.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagccctacatggagttgaggagcctgacatctgacgacaccggaccgtctatttactgtgccgagacgtcccacgatccggtgagtcctacggcagcggcctttgacttctggggccagggtacg

SEQ ID NO: 532169 - DNA, 507 bp, Homo sapiens
  misc_feature: HEFZJCU01A1118.10.38.D05.1.454.heavy.3.raw
  modified_base (477)..(477): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacangactacgctcaattctggggccaggggacg

SEQ ID NO: 532170 - DNA, 521 bp, Homo sapiens
  misc_feature: HEFZJCU01A02KY.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctgggagggtccctaagactctcctgtgcagcctctggactcaccttcacgctcaatggccactacgtggactgggtccgccaggctccgagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacaccggccgtctattattgtgtcatagacctaggatacaacgacggtggtacctggtattc

SEQ ID NO: 532171 - DNA, 516 bp, Homo sapiens
  misc_feature: HEFZJCU01AY2VB.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgcaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgagtacggctgtctatcattgtgttttcgatgccgttcggtccgccgggtacttcgtcggggtccaggggaaccc

SEQ ID NO: 532172 - DNA, 524 bp, Homo sapiens
  misc_feature: HEFZJCU01A1TVV.13.76.G10.1.454.heavy.3.raw
  modified_base (497)..(497): a, c, t, g, unknown or other
tcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggggtccgccaggcctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacggaacgttactacgctangggacgtcgtggggccaaggggacccg

SEQ ID NO: 532173 - DNA, 531 bp, Homo sapiens
  misc_feature: HEFZJCU01BC0SM.17.34.D01.1.454.heavy.3.raw
  modified_base (255)..(255): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattatataacactgcttcctttttacacctcccttgacttcgtgggccagtcggaaccccggtcc

SEQ ID NO: 532174 - DNA, 517 bp, Homo sapiens
  misc_feature: HEFZJCU01CMDE6.52.67.G01.1.454.heavy.3.raw
cgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaaagacacggctgtatattactgtgcgagaggggaaatgggtaaggtatttttggtagtaattattatcctcgggcggtgcggacgtcgtc

SEQ ID NO: 532175 - DNA, 493 bp, Homo sapiens
  misc_feature: HEFZJCU01C59G3.51.38.D05.1.454.heavy.3.raw
cgatcgtatacacgaccggtgctcgatttagtatctgatagttgggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaagggggctggactgggtggcaggcatatcatttgatggaagcaagaagtactatgcagactccgtgaagggccgattcaccatctccagagacagttccgatgacacagtctatctacacatgagcagtgtgagacctgacgacacggcttctttttactgtgcgccgaggaagcgagtgc

SEQ ID NO: 532176 - DNA, 505 bp, Homo sapiens
  misc_feature: HEFZJCU01CWH8A.48.82.H05.1.454.heavy.3.raw
agtatacatacacgaccggtgctcgatttagtcgagctctctcgcgggcacgaccggtgctcgatttagacgcgatcgaagggtttgggagctctgggagacgagcccagcactggaagtcgccggtgtttccattcggtgctcagcactgaacacagaggactcaccatggagtttgggctgaactgggtttcctcgttgctcttttaagagatgtccagtgtcgggtgcagttggtggagtcggggggaggtgtggtccagcctgggaagtccctgacactgtcctgcgcagcctctggattcaccttcgccacctttcgtatgcactttgtccgccaggctccaggcaaggggctggagtgggtggctgttgtgtcaaatgatggacatgctgaatatgcagactccgtgagggggccgattcgccttctccagagacaattccaagacgcacggttcactctgcaaatgagcgaccctgacgacctgacgacacggctggt

SEQ ID NO: 532177 - DNA, 508 bp, Homo sapiens
  misc_feature: HEFZJCU01BMV9P.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccagggcccatcggtcttccccctggcaccctcctccaagagcacctctgggggcacagcggccctgggctgcctggtcaggactacttcctacgtcgtat

SEQ ID NO: 532178 - DNA, 522 bp, Homo sapiens
  misc_feature: HEFZJCU01B2REE.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctaacaacccgtccctcaagagtcgagtcagcatgtcagtcgacacgtcccagaaccagttctccctgacagtgagttatatgaccgccgcagacacggccgtgtattactgtgcgagagaggccgttagttttaggtacagctagttaaaactcctactacggtctggacgtcgtggggccaggggaccaac

SEQ ID NO: 532179 - DNA, 459 bp, Homo sapiens
  misc_feature: HEFZJCU01B1T6H.18.33.C11.1.454.heavy.3.raw
tacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggacggactgggaggaggcttgatccagccgtgggggggtccctgagactctcctgtgcagtctcgtgggttcgtcagtggcgactacatgagctgggtccgccaggctccagggaagggctgggagtggctcgctacttatttacaggtggcggtcaccgttacaattacctacacagtactttcggcgacggggggccgatttcaaccattctccaacgagacgataccaagaacacgttgtattctactaaatgaaca

SEQ ID NO: 532180 - DNA, 518 bp, Homo sapiens
  misc_feature: HEFZJCU01EMBI7.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctcccagcctccaccaagggcccatcggtccttcccctggccgccctcgctccaggacgcacccg

SEQ ID NO: 532181 - DNA, 509 bp, Homo sapiens
  misc_feature: HEFZJCU01BNYE2.48.25.C03.1.454.heavy.3.raw
agtatacatacacgaccggtgctcgatttagtagtgtagatttgggtttgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgaggggccgattcaccatctccagagacaacccccgaaactctctttttctgcaaatggacagcctgacagccgacgatacggccatttattactgtgcgagagatgggacccccgcatatccagaaggcacactctactttgacctctggggccaggggatcctggtcaccgtctcctcagcctccaccaagggcccatcggtcttcccctggcgccctgctccaggagcacctccgagagcacagcggccctcgggctgcctggtcaaggactacttcctatgtatct

SEQ ID NO: 532182 - DNA, 505 bp, Homo sapiens
  misc_feature: HEFZJCU01BB476.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggtccggttcaccctctccagagacacttccaacaacatcttgtatcttcacatgcacaatctgagagtcgacgacacggccacctattattgtgcgcgacatgactacgctcaattctggggcagggacg

SEQ ID NO: 532183 - DNA, 529 bp, Homo sapiens
  misc_feature: HEFZJCU01AOHPO.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggtcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgttgtcagagatccggcccataactggctcggccctggggcccgggaaccctggtcaccgtctctcagcctccaccaacggcccactcggtcttcccctcggcaccctcc

SEQ ID NO: 532184 - DNA, 527 bp, Homo sapiens
  misc_feature: HEFZJCU01CTT6U.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctggggtccgccaggctccagggaaggggctggagtgggtttcatacatttatcctagtggtgataccatatactacgcagactctgtgaagggccgattcaccatctccagggacaacgaccaagaactcactgactttgcaaatgaacaccctgcgagccgaggacacgggccgtatattactgtgcgagaaataacccgttcgccttggttactttacc

SEQ ID NO: 532185 - DNA, 503 bp, Homo sapiens
  misc_feature: HEFZJCU01B9CGY.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgttggagcttttgactactggggccagggaaccctggtcatcgtctcctcagcctccaccaagggcccatcggtcttcccctggcaccctcctccagagcacctctgggggcacagcggccctgggctgcctggtcaaggactactccgagtagtaca

SEQ ID NO: 532186 - DNA, 502 bp, Homo sapiens
  misc_feature: HEFZJCU01BOMU9.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgcctgagacctgacgacacggctgtctattactgtgcgagagggcgtccgagtttaacacgccgtcgggagggatattactttgacaactgggggccagggaaccctggtcaccgtctcctcagcctccaccaagggcccatcggtcttcccctggcgccctgctccaggagcacctccgagagcacagcggccctgggctgcctggtcaaggactacttcctactgtatact

SEQ ID NO: 532187 - DNA, 496 bp, Homo sapiens
  misc_feature: HEFZJCU01ECRV0.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccta

SEQ ID NO: 532188 - DNA, 524 bp, Homo sapiens
  misc_feature: HEFZJCU01ED6VV.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcgtgggggccgaggggaccctggtcatcgtctccccagcctccaccaaggcccatcggtcttcccctggccg

SEQ ID NO: 532189 - DNA, 483 bp, Homo sapiens
  misc_feature: HEFZJCU01CXU08.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaaggcccatcggtccttccccgtggccgccctgctccaggagcacctccgagagcacagcggccctgggctgctggtcaggactactcctactcgtat

SEQ ID NO: 532190 - DNA, 515 bp, Homo sapiens
  misc_feature: HEFZJCU01ENTK2.53.62.F07.1.454.heavy.3.raw
cgcgtatacacacgaccggtgctcgatttagtagtcgcataaaagggaaaggggaagactgacggtcctcccaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtcttactatgatgccagtggtttagttaccgttcgaccccgtggggccgagggaacccgtggtcaccgtctccttcagcttcccaccaacgggcccactcggttccttcccccttcggccgccctcgcct

SEQ ID NO: 532191 - DNA, 512 bp, Homo sapiens
  misc_feature: HEFZJCU01DRCPA.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccgaagggacaatggtcatcgtctcctcagcctccaccaagggcccatcgtcttcccctcggcaccctcctccaagagcacctctgggggcacagcggccctgggctgtccg

SEQ ID NO: 532192 - DNA, 526 bp, Homo sapiens
  misc_feature: HEFZJCU01CJKD7.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccattcaccatctccagagacaattccaagaacacgctgtttcttcaatgaacagcctgagagccgatgacacggccgtgtattactgtgcgagagagtcggggcccacgaaccgttactacgctatcgggacgtcgtgggggccgaagggacccg

SEQ ID NO: 532193 - DNA, 482 bp, Homo sapiens
  misc_feature: HEFZJCU01EY6OK.4.37.D04.1.454.heavy.3.raw
  modified_base (439)..(439): a, c, t, g, unknown or other
  modified_base (473)..(473): a, c, t, g, unknown or other
agcactgtagcacgaccggtgctcgatttagtagcatactgttgggtttgggggagcatcacccagcaaccacatctgtcctctagagaatcccctgagagctccgttccctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcaggggtcaccatcgaccagggacacgtccatcagcacgtccatcagcacacgcctacatggacctgancggctgacatctgacgacacggccgtatatttcngtgcgaggg

SEQ ID NO: 532194 - DNA, 507 bp, Homo sapiens
  misc_feature: HEFZJCU01EOFEK.52.70.G04.1.454.heavy.3.raw
  modified_base (391)..(391): a, c, t, g, unknown or other
cgcagtacgacacgaccggtgctcgatttagtgtagtgtgaagggaaaggggacccaacaaccacatccctcctcagaagccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacncagcctatatggaactcagcagcctgagatctagaagacgacggctgtctattactgtgcgagggtcggcacgctgacaaccttcttacttctattcctacgctatggacgttctc

SEQ ID NO: 532195 - DNA, 521 bp, Homo sapiens
  misc_feature: HEFZJCU01BOATQ.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaacgggccgattcaccatctccagagaccattccaagaacacctatatcttcaaatgaacaacctgagagtacgaagacacggccgtatattactgtgcgagacatgacttcggtgaccccgtggggccagggaaccctaggtcaccgtctcctca

SEQ ID NO: 532196 - DNA, 373 bp, Homo sapiens
  misc_feature: HEFZJCU01ACX0S.3.42.D09.1.454.heavy.3.raw
agacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctcctgggggcacagcggccctgggctgcctggtcaaggactacttccgagtgcgtct

SEQ ID NO: 532197 - DNA, 513 bp, Homo sapiens
  misc_feature: HEFZJCU01DBJG0.10.38.D05.1.454.heavy.3.raw
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacaccttccaacaacatcttgtatcttcacatgcacaatctgagagtcgacgacacggccacctattattgtgtcgcgacatcgactacgctcaattctcgggggccaggggacg

SEQ ID NO: 532198 - DNA, 574 bp, Homo sapiens
  misc_feature: HEFZJCU01B1INU.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaaatgatggtgagaaaatagactacggtgcacccgtgaaaggaagattcaccatctcaacgagataattcaaaaacgacggtgtatttgcaaatgaacagcctagaaaaccgaggacacagccgtctattactgtaccacagattacggaagtgcaatcgacgtaaaagggacggacttaagtgtctttttaggattaatcgttacgggggacccaggggtaaccaaagtt

SEQ ID NO: 532199 - DNA, 421 bp, Homo sapiens
  misc_feature: HEFZJCU01ALYUG.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaaggcccatcggtcttccccctggccaccctcctccaagagcacctctggggcacagcggcctgggctgcctggtcaaggactacttccgagtagtaca

SEQ ID NO: 532200 - DNA, 515 bp, Homo sapiens
  misc_feature: HEFZJCU01DCOZ2.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctcagagacaacgccgacaactcactgtctctgctgatgagcagcctgagagccgacgacacggctatctattactgtgcgaaactctcattccgttcatctgaatacgtggggccgaggggaacccctggtccgtccg

SEQ ID NO: 532201 - DNA, 500 bp, Homo sapiens
  misc_feature: HEFZJCU01D2QBM.12.14.B03.1.454.heavy.3.raw
atacgacgtacacgaccggtgctcgatttagtgtgagtagttccgccgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttccccctggcaccctcctccaagagcacctctgggggcacagcggccctgggctgcctggtcaaggactacttcctacgtcgtat

SEQ ID NO: 532202 - DNA, 502 bp, Homo sapiens
  misc_feature: HEFZJCU01D3XAV.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttattactgtgcgcgagataatagtcacaactggaacggcggttttggggtgggttc

SEQ ID NO: 532203 - DNA, 511 bp, Homo sapiens
  misc_feature: HEFZJCU01ALJM2.48.25.C03.1.454.heavy.3.raw
agtatacatacacgaccggtgctcgatttagtagtgtagatttgggtttggggtctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctcctagagaagacgccaagaattccttgtatcttcagatgaacagtctgagaaccgatgacacggctgtgtattattgtgacgaaaaggggggtagcgagctcgtccatccacttcg

SEQ ID NO: 532204 - DNA, 516 bp, Homo sapiens
  misc_feature: HEFZJCU01APVHU.48.34.D01.1.454.heavy.3.raw
agtatacatacacgaccggtgctcgatttagatcgtctgtgttgggtttggggggaaaaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttccatgtata

SEQ ID NO: 532205 - DNA, 517 bp, Homo sapiens
  misc_feature: HEFZJCU01ALSQA.49.55.E11.1.454.heavy.3.raw
agtcgagagacacgaccggtgctcgatttagcactcgcacgttgggtttgggtctgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatagaacagcctgagagccgaggacacggctgtgtattactgtgcgagagacgtccccgggtatacgcagtgtctggtacatattacgtc

SEQ ID NO: 532206 - DNA, 504 bp, Homo sapiens; identical to SEQ ID NO: 445648
  misc_feature: HEFZJCU01BI4GR.17.25.C03.1.454.heavy.3.raw

SEQ ID NO: 532207 - DNA, 534 bp, Homo sapiens
  misc_feature: HEFZJCU01BXBUE.14.57.F02.1.454.heavy.3.raw
cgtctagtaccacgaccggtgctcgatttagctcgatatagttgggtttgggctgagttggctctttcttgtggctattttaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaggcccatcggtcttccccctgccacctcctccaagagcacctctgggggcacagcc

SEQ ID NO: 532208 - DNA, 520 bp, Homo sapiens
  misc_feature: HEFZJCU01CWF16.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggccccgagccggcagtggtcgtttttgtatgcctttgtatattgtggggaccgaggggaacaagtggtacaccgttcc

SEQ ID NO: 532209 - DNA, 484 bp, Homo sapiens
  misc_feature: HEFZJCU01DR7OP.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcaggggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctggcgccctgctccaggagcacctccgagacggccctgggctgcctggtcaaggactacttcccactactcgta

SEQ ID NO: 532210 - DNA, 518 bp, Homo sapiens; identical to SEQ ID NO: 455011
  misc_feature: HEFZJCU01ECW98.9.34.D01.1.454.heavy.3.raw

SEQ ID NO: 532211 - DNA, 527 bp, Homo sapiens
  misc_feature: HEFZJCU01ED25K.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagcccgatgacaccggccgtgtattactgtgcgagagatggggcccaacgaacgttactacgtctatggacgtcgtcggggccgaagggacccg

SEQ ID NO: 532212 - DNA, 512 bp, Homo sapiens; identical to SEQ ID NO: 451632
  misc_feature: HEFZJCU01ELG3V.4.23.C01.1.454.heavy.3.raw

SEQ ID NO: 532213 - DNA, 517 bp, Homo sapiens
  misc_feature: HEFZJCU01DONG6.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 532214 - DNA, 531 bp, Homo sapiens
  misc_feature: HEFZJCU01CJ5SI.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactaccaacccgtccctcaagagccgagtcaccatcttagtggacacggcgaagaaccagttctccctgaactgaccgctgtgaccgccgcggacacggctgtgtattactgtgcgagacgaagtgggcgggtggctacgacttgacttttgggccagggaaactggtcaccgtccttccccagtcttccaccaacgggacccatcggtccttcccccg

SEQ ID NO: 532215 - DNA, 532 bp, Homo sapiens
  misc_feature: HEFZJCU01EY5QL.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagttgggttcgggggacctcaccccgttggttcttacttcgtatctcgtgggggcc

SEQ ID NO: 532216 - DNA, 496 bp, Homo sapiens
  misc_feature: HEFZJCU01CPK6H.14.25.C03.1.454.heavy.3.raw
  modified_base (433)..(433): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgcaggctccaggcgaggggctggagtgggtggcgattatatcacatgatggaactaatagacgctatgccgactccgtgaagggccgattcaccatctccagagacaattccaagaacacgcagtatctgcaaatgaacanccgtagagagctgaggacacggctgtgtattactgtggggagagatggaggtcgatattgtta

SEQ ID NO: 532217 - DNA, 433 bp, Homo sapiens
  misc_feature: HEFZJCU01CWX8E.4.37.D04.1.454.heavy.3.raw
agcactgtagcacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggccctggacaagggcttgagtggatgggatggatcgaccctaacagcggtggcacaaagtatgcacagaagtttcgagggcaggggtcaccatggaccgagggacacgtccatcagcacgtccatcagcacagcctacatgga

SEQ ID NO: 532218 - DNA, 519 bp, Homo sapiens; identical to SEQ ID NO: 450675
  misc_feature: HEFZJCU01BNCM5.13.76.G10.1.454.heavy.3.raw

SEQ ID NO: 532219 - DNA, 517 bp, Homo sapiens
  misc_feature: HEFZJCU01AMK6Z.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaggggctggagtgcgtctcttttatttatagtagtggtagtacatactccgcagactccgtggaggggccgattcaccatcctccagagacaattccaagaacacgctgtttcttcaaatgaacagcctgagagccgatgacacggccgtgtattactgtgcgagagatggggcccacgaacgttactacgctatggtacgtcgtcgggacc

SEQ ID NO: 532220 - DNA, 536 bp, Homo sapiens
  misc_feature: HEFZJCU01B7Q8D.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccaggggacgccctggtcacccg

SEQ ID NO: 532221 - DNA, 514 bp, Homo sapiens
  misc_feature: HEFZJCU01C6WDV.40.36.D03.1.454.heavy.3.raw
tctagcgactcacgaccggtgctcgatttagctgcgtcacgatctctcttgggggggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccagggaaggggctgggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttacctccgatactgactta

SEQ ID NO: 532222 - DNA, 337 bp, Homo sapiens
  misc_feature: HEFZJCU01DO41J.11.26.C04.1.454.heavy.3.raw
cgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggcctgggctgcctggtcaaggactacttccgtatctctcg

SEQ ID NO: 532223 - DNA, 532 bp, Homo sapiens
  misc_feature: HEFZJCU01BKBQH.17.34.D01.1.454.heavy.3.raw
  modified_base (434)..(434): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctgagctgaacagcctgtcatctgnggacacgggcttctacttctgtgcgaggagtaattactataacactgctccttttacacctcccttgactttctggggccagtcggaaccccggtccg

SEQ ID NO: 532224 - DNA, 517 bp, Homo sapiens
  misc_feature: HEFZJCU01AGZZT.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctatttactgtgcgagagactacggtgaccttttctggtatttcgatctctgggccgtggcacctggtcactgtctcctcggcttccaccaagggcccatcggtcttcccctggccgccctcgctccaggagcacctctcgggggcacagccggtccc

SEQ ID NO: 532225 - DNA, 505 bp, Homo sapiens; identical to SEQ ID NO: 468193
  misc_feature: HEFZJCU01BUO9D.26.80.H03.1.454.heavy.3.raw

SEQ ID NO: 532226 - DNA, 522 bp, Homo sapiens
  misc_feature: HEFZJCU01B5DOC.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctatttacctggtgcggagtacgtcccacgattccggtagagcccgtacggccaggccggtccctttggacctttcgtc

SEQ ID NO: 532227 - DNA, 509 bp, Homo sapiens
  misc_feature: HEFZJCU01DQMOX.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagtccttgagtggatggggatggatgaacgttgacaatgggaatacgagatattcacagaaattccagggcagagtcaccattacccagggacacatccgcgaacacagcctacatggagctgacgggcctgacatctgaagacgacggcctttatattactgtgcgcgagatggctggcacgagagggcacaactggctcgtaccc

SEQ ID NO: 532228 - DNA, 506 bp, Homo sapiens
  misc_feature: HEFZJCU01CGGDY.48.57.F02.1.454.heavy.3.raw
  modified_base (478)..(478): a, c, t, g, unknown or other
agtatacatacacgaccggtgctcgatttagctcgatatagttgggtttggggagctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgagttcgccttctccagagacaattcaagagcacggttcatctgcaatgagcgcctgagacctgacgacacggctgtctattacttgtcgcgngagggcgtccgagtttaacacggccgtc

SEQ ID NO: 532229 - DNA, 528 bp, Homo sapiens
  misc_feature: HEFZJCU01EO2MN.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacgggcctgtattactgtgcgagagacccctcgatagcagtgctggtccactaggtttgacttagtggggccaggggaagcgttggtccaccgtcctcctcagcctacccg

SEQ ID NO: 532230 - DNA, 506 bp, Homo sapiens
  misc_feature: HEFZJCU01A9OD6.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagtcttttgactactggggccagggaaccctggtcatcgtctcctcagcctccaccaagggcccatcggtcttcccctggccaccctcctccagagcacctcgtggggcacagcggcctgggctgcctggtcaaggactacttccgagtagtaca

SEQ ID NO: 532231 - DNA, 507 bp, Homo sapiens
  misc_feature: HEFZJCU01CGVX3.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaagggctggagtgggtttcatatattgatagaaattagtggaaccatatactatgcagactctgtgaggggccgattcaccatctccagagacaatgccaggaattcactgtatgtggaaatgaacagtctgagagcgaggacacgggctctctattactgtgcgagagccccgaaaatac

SEQ ID NO: 532232 - DNA, 523 bp, Homo sapiens
  misc_feature: HEFZJCU01AW1U1.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcacatctccagagacaattccaggaacacaatgtagtttggagctgaacagcctaagtcctgaggacacgggcgtatactactgtacgaagggacggggggaacgaggacgggagttccgaagtactctttgtacgtcgtc

SEQ ID NO: 532233 - DNA, 521 bp, Homo sapiens
  misc_feature: HEFZJCU01A1F9T.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggtcaccatctccagagatgattcagagaacacggcgtatctgcaaatgaacagcctagaaaaccgaggaacacggccgtgtattactgtgcagacatcccgtcgtattacgtatttttctattggtccc

SEQ ID NO: 532234 - DNA, 541 bp, Homo sapiens
  misc_feature: HEFZJCU01A4CFF.17.28.C06.1.454.heavy.3.raw
  modified_base (527)..(527): a, c, t, g, unknown or other
cgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaatagtggctgtgtttagttggggcctaggggancccctggtccaccg

SEQ ID NO: 532235 - DNA, 499 bp, Homo sapiens
  misc_feature: HEFZJCU01EJVJO.51.38.D05.1.454.heavy.3.raw
cgatcgtatacacgaccggtgctcgatttagtatctgatagttgggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacgacggtcttctttttactgtgcgccaggaagcaggtgcgtcgga

SEQ ID NO: 532236 - DNA, 507 bp, Homo sapiens
  misc_feature: HEFZJCU01A92AK.11.57.F02.1.454.heavy.3.raw
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggttcttcgtggctcacgtccacccaccacgcatgtgacctcaggggtccgccaggctccaggtaaggggctggaatggatttcatacattagcagtagtggtgcgaccatatactacgcagactctgtgaagggccgattcatcatctccagagacaatgcaacaactcactgtatctggaaatcaacagcctgagagtcgaggacacgg

SEQ ID NO: 532237 - DNA, 485 bp, Homo sapiens
  misc_feature: HEFZJCU01DT7W2.52.50.E06.1.454.heavy.3.raw
  modified_base (392)..(392): a, c, t, g, unknown or other
  modified_base (481)..(481): a, c, t, g, unknown or other
cgcagtacgacacgaccggtgctcgatttagatctactgacaacacacaaggggacccaacaaccacatccctcctcagaagcccccagagcacaacgcctcaccatggactggacctggaggatcctctttttggtggcagcagccacaggtgcccagtcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacacacactattcacagaagttgcagggcagagtcaccatccaccgagggacacatcccgngagcacagcctacatggaactgagcagcctgagatctagaagacacggctgtattattactgtgcgagagggaaggtggatattgaagntgcg

SEQ ID NO: 532238 - DNA, 520 bp, Homo sapiens
  misc_feature: HEFZJCU01BYM3O.13.76.G10.1.454.heavy.3.raw
tcacgtactacacgaccggtgctcgatttagtcactcatacagggggggagaggagcccagcactgggattccgaggtgttcccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggaccg

SEQ ID NO: 532239 - DNA, 405 bp, Homo sapiens; identical to SEQ ID NO: 445302
  misc_feature: HEFZJCU01AIR7W.3.17.B06.1.454.heavy.3.raw

SEQ ID NO: 532240 - DNA, 527 bp, Homo sapiens
  misc_feature: HEFZJCU01A4H5L.10.44.D11.1.454.heavy.3.raw
catagtagtgcacgaccggtgctcgatttagcgcagtacgaagggggggagaggagccccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcgtggtccagcctgggaggtcacagagactctcctgtgcagcctctgggttcaccttcagtagctacggcatgcactggggtccgccaagctcccaggcaaggggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaagggaggggggaaccaagcgggagtccaagtactcttgtacgtcgtcgggcgtac

SEQ ID NO: 532241 - DNA, 525 bp, Homo sapiens
  misc_feature: HEFZJCU01DFH6A.47.55.E11.1.454.heavy.3.raw
  modified_base (383)..(383): a, c, t, g, unknown or other
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcngcatctccagagacaacggcaagagtatactgtatctggaaatgaaacaatctgagagtcgagatacggctgtcttatacctaattgttggtttttcgatcgtccgtttccggtccgcgggtctttcgtcggggtccgaacc

SEQ ID NO: 532242 - DNA, 512 bp, Homo sapiens
  misc_feature: HEFZJCU01D2N5A.4.30.C08.1.454.heavy.3.raw
agcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtctgggggaggcttggtccagcctggggggtccctgagactctcctgtgcagcctctggattcacctttactacctattggatggactgggtccgccaggctccagggaaggggctggagtgggtggccaacataaaccaagatggaagtgaacagtactatgtggactctgtgaagggccgattcaccatctccagagacaacgccaagaactcactgtatctgcaaatgaacagcctgagagccgaggacacggctatttattactgtgtgaaagagaactggttcttcgatctcgtggggccgtgg

SEQ ID NO: 532243 - DNA, 534 bp, Homo sapiens
  misc_feature: HEFZJCU01CD11U.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgacttactggggcccaggggaagccgtttggtcacccgttctcctcacggcctcccg

SEQ ID NO: 532244 - DNA, 543 bp, Homo sapiens
  misc_feature: HEFZJCU01CHIUL.48.67.G01.1.454.heavy.3.raw
  modified_base (218)..(218): a, c, t, g, unknown or other
agtatacatacacgaccggtgctcgatttagagtatacatattgggtttgggggggagaggagcccagcactgggattccgaggtgtttccattcggtgatcagcactgaacacagaggactcaccatggagttttggctgaggtgtccagtgtgaggtgtagctggtggagtctggaggaggcttgccccagcctgggaggtccctaagactttccngtgcagcctctgggtttagtgtcactagtaggaagatgacttgggtccaccaggctccagggaaggggctggagcgggtcgcaattctttacagtggtgttaggacaacctacgcagactccgtgaaggggcgattcaccttctccagaggcaattccaagaacaccctgtgtcttcgtgggtctcatttctttatagcggtgttaggacaacctacgcagactccgtgaagggggcgattcaccttctccagaggcaattccaagaacacccgtgtactcttcaaataacagtctaagagccgaggacacggccctgtcgttac

SEQ ID NO: 532245 - DNA, 500 bp, Homo sapiens
  misc_feature: HEFZJCU01BSHEA.53.58.F03.1.454.heavy.3.raw
cgcgtatacacacgaccggtgctcgatttagtctgatcgagaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccgaggacacgtccagtcagcactgcctacatggagctgaccaggcctgaatttgaggacacggccacgtttatactgtgcaaggaacagcataatgactcgtcccccggactttcg

SEQ ID NO: 532246 - DNA, 542 bp, Homo sapiens
  misc_feature: HEFZJCU01AJ5QO.12.40.D07.1.454.heavy.3.raw
atacgacgtacacgaccggtgctcgatttagtgatagagcgtaacaacagagggctcaccatggagtttgggctgagctgggttttcctcgttgctctttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggacccgtacggtcgtactcgtccgtccctaccgactcccaccaacggacccgactcgtcgtcccctcggccgcctcg

SEQ ID NO: 532247 - DNA, 513 bp, Homo sapiens
  misc_feature: HEFZJCU01CH3FS.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctcaccaagggcccatcggtcttcccctggcacctcctccaagagcacctctgggggcacgagcggccctggggcctgcctggtcaaggctacttcccgagtgcgtct

SEQ ID NO: 532248 - DNA, 518 bp, Homo sapiens
  misc_feature: HEFZJCU01EG2AX.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagcccgacgacaccggcctatttattactgcgacgaaggaatatacgggtcgacaacggtggctacgcgtttctag

SEQ ID NO: 532249 - DNA, 523 bp, Homo sapiens
  misc_feature: HEFZJCU01C6DIU.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgatttcaccatctccagagacaattacaagaacaccctttatctgcaaatagacagcctgagaccagacgacacggctgtctattaattgtcgcgagagagacacacgaacctactggccaatactatggggcttgttctggggccaggggaccctggcatcgtctccccagcctccaccaagggccatcgtcgttccccctggccg

SEQ ID NO: 532250 - DNA, 499 bp, Homo sapiens
  misc_feature: HEFZJCU01BCZQF.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatgacgtggacttc

SEQ ID NO: 532251 - DNA, 495 bp, Homo sapiens
  misc_feature: HEFZJCU01CHR31.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagacctccctgaggggccgattcaccatctccagagacaattcccagaacacggtctatctgcacctgaccacgcctggagaactgacgacacgtctctctactactgtgcggagagagttgacgagt

SEQ ID NO: 532252 - DNA, 520 bp, Homo sapiens
  misc_feature: HEFZJCU01C0BOQ.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtcccgccaaactccaggcaagggattggagtgggtggcagttgtttcatctgagggcagtgttcaatggtatgctgacgccgtgaagggccgattcaccatctccagagacaactccaggaacacaatgtatttggcctgacagcctaagtcctgaggacacgggtgtatactactgttacgaagggaggggggaaccgagcgggagttcctaagtacttcctttg

SEQ ID NO: 532253 - DNA, 507 bp, Homo sapiens
  misc_feature: HEFZJCU01EF0MM.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccaggggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctacggaaccccgatgttc

SEQ ID NO: 532254 - DNA, 533 bp, Homo sapiens
  misc_feature: HEFZJCU01BPU77.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttattttgtacgtagagcgtcgtctgtcagtggaattggctacgtggggccagggtaaccctggtctaccggtctcctcagccctccacc

SEQ ID NO: 532255 - DNA, 393 bp, Homo sapiens
  misc_feature: HEFZJCU01DPGZN.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggccaccctcctccaagagcacctctggggcacagcggccctgggctgcctgtcaagatacttcccatactcgta

SEQ ID NO: 532256 - DNA, 512 bp, Homo sapiens
  misc_feature: HEFZJCU01BVHKA.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagactttaccatcgaccacgaactcctccataaacacagcctacatggagttgaggagcctgacatctgacgacacggccgtctattactgtgcgagagtcccacgatccggtgagcctacggcaggcggcctttgactttctggggccaggggacg

SEQ ID NO: 532257 - DNA, 545 bp, Homo sapiens
  misc_feature: HEFZJCU01AERWG.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctaagccgactccgtgaagggccgattcaccatctccagagacaattccaagaacacggtagaatcttacaaatgaacagcctgagaaccgaggacacggccgtatattattgtataggttatggtggtaattcgggcccctggggccagggaaccgtggtcaccgtctcctcagcctccaccg

SEQ ID NO: 532258 - DNA, 546 bp, Homo sapiens
  misc_feature: HEFZJCU01BS4Q9.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagtttgggctgagctggattttccttgctgctattttaaaaggtgtccagtgtgaggagcagttggtggagactggaggaagcctgatccagccgggggggtccctgagactgtcctgtgcagtctctgggttcgtcagtggcgactacatgagctgggtccgccaggctccagggaagggcctggagtggatctcacttatttatagtggtggtaccacatactacacagactccgtgaagggccgattcaccatctccagaagacaattccaggaacacattgtatcttcaaatgaataacctgagagccgaggacacggccatgtattactgtgtgggggcatttacttgacccctgggggcccgggggaacccgtgggtccgtacccgtctcccccacccctcccaaccccg

SEQ ID NO: 532259 - DNA, 514 bp, Homo sapiens
  misc_feature: HEFZJCU01D53R0.48.2.A02.1.454.heavy.3.raw
agtatacatacacgaccggtgctcgatttagactcatctacagggggtctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaaccgagatggaaataagatatactatgtggactctgttaagggccgattcaccatctccagagacaacgccaagagttcactgtttctgcaaatgagcagcctgagagccgacggacacgggactctatattactgtacgagagattttcacgcccctcccaaacgtggaaaattatta

SEQ ID NO: 532260 - DNA, 507 bp, Homo sapiens
  misc_feature: HEFZJCU01A6456.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatctttcacatgcacaatctgagagtcgacgacacggccacctattattgtgcgcgacatgactacgctcaattctggggccagggacg

SEQ ID NO: 532261 - DNA, 508 bp, Homo sapiens
  misc_feature: HEFZJCU01A4EYU.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagaccgtgacgacacggccctctattactgtgcgaggccctatcctacagtgaccactccacgctggttcgacctcgtcggggcac

SEQ ID NO: 532262 - DNA, 527 bp, Homo sapiens
  misc_feature: HEFZJCU01CHXDA.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggtggtccctgagactctcctgtgcagcctctgggttcaccgtcagtcacacctacatgagttgggtccgccaggctccagggaagggctggagtgggtctcctttatttacagcagtggtagtacatattccgcagactccgtgaggggccgattcaccatctccagagacaactctaagaacacgctgtttcttcaatgaacagcctgagagccgatgacacggccgtgtattactgtgcgagagatcggggcccacgaacgttactacgctatggacgtcgtggggccaagggtaccg

SEQ ID NO: 532263 - DNA, 506 bp, Homo sapiens
  misc_feature: HEFZJCU01DJIKR.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctgggagtggggtttcatatattgatagaaataagtggaaccatatactatgcagactctgtgaggggccgattcaccatctccagagacaatgccaggaattcactgtatgtgaaatgaacagtctgagagccgaggacacggctcgtctattactgtgcgagagccccgaaatagggtctacg

SEQ ID NO: 532264 - DNA, 521 bp, Homo sapiens
  misc_feature: HEFZJCU01A1IPW.19.67.G01.1.454.heavy.3.raw
  modified_base (484)..(484): a, c, t, g, unknown or other
  modified_base (503)..(503): a, c, t, g, unknown or other
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacggacattctacggagactccatggagggccgattcaccatctccagagacttttctcagaacacactgtctcttcaaatgaacagcctgacgggccgaggacacggccgtctattattgtgtgagagttttanggcgatggcgtggtggacngatcgactggggcctaac

SEQ ID NO: 532265 - DNA, 523 bp, Homo sapiens
  misc_feature: HEFZJCU01D1SVT.8.34.D01.1.454.heavy.3.raw
ctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaatccaggaacacaatgtatttggagctgaacagacctaacgtcctgaggacacgggcgtatactactgtacgaaggaggggggaaccgaggcggaggttcaacgtactaccttt

SEQ ID NO: 532266 - DNA, 534 bp, Homo sapiens
  misc_feature: HEFZJCU01CD4LE.16.87.H10.1.454.heavy.3.raw
  modified_base (489)..(489): a, c, t, g, unknown or other
tgtactactccacgaccggtgctcgatttagcagtactgcgttgggtttgggggagcccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcagggccgattccaccgtctccagagacaacaccaagaacacactatatctgcagattgaacagtctgagacccgaggacacggctgtggttatactgtgcaaggcagttcgtggaaacngttatggttggggggagttggggtttttttttcttacgtacgggt

SEQ ID NO: 532267 - DNA, 531 bp, Homo sapiens
  misc_feature: HEFZJCU01BD32R.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggattgactactgggccagggaaccctggtcaccgtctcctcagcctcaccaacggg

SEQ ID NO: 532268 - DNA, 513 bp, Homo sapiens
  misc_feature: HEFZJCU01DFQY8.49.59.F04.1.454.heavy.3.raw
agtcgagagacacgaccggtgctcgatttagtacacacacttagggattggggacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggcagaatcacgataaccgcggacacatccacgagcactattttcatggaactgagcagcctcagatccgaggacacggccgtttactactgtgcgagcgatccggattcccgcgtttcgaggatgactacgtgggccagggaaccctggtcaccgtct

SEQ ID NO: 532269 - DNA, 523 bp, Homo sapiens
  misc_feature: HEFZJCU01DCN0M.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagtttattagtccctactttgacttactggggccagggaaactcgtggtcaccgtctccgcagcctaccaccaacgggcccatcc

SEQ ID NO: 532270 - DNA, 516 bp, Homo sapiens
  misc_feature: HEFZJCU01DQT66.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaacaggcggagttccaagtactccg

SEQ ID NO: 532271 - DNA, 464 bp, Homo sapiens
  misc_feature: HEFZJCU01DIOA8.10.85.H08.1.454.heavy.3.raw
catagtagtgcacgaccggtgctcgatttagtatcactcagtcgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctcggcgccctgctccaggagcacctccgagagcacagcggccctgggctgcctggtcaaggactacttcccactactatg

SEQ ID NO: 532272 - DNA, 508 bp, Homo sapiens
  misc_feature: HEFZJCU01EEBSA.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactctactttatctgcaaatgaacagcctgagaaccgacgacacggccgtctattattgtgtcatagacctaggatacaacgac

SEQ ID NO: 532273 - DNA, 530 bp, Homo sapiens
  misc_feature: HEFZJCU01CM5RB.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccggtattaaaccaaaactgatggtgggacaacagactacgctgcacccgtgaaaggcagattcaccatctcaagagatgattcaaaagcacgctgtatctgcaaatgaacagacctgagaaccgaggacacagccgtgtattactgtaccacatcccctgaaagcgtcaactactactactacgtatgactcg

SEQ ID NO: 532274 - DNA, 530 bp, Homo sapiens
  misc_feature: HEFZJCU01AYIZR.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcaggtgttcaagtggtatgcagactccgtggaagggccgattcaccatctccagagacaattccagggaacacaatgtatttggaaatgaacagctaagtctgaggacacggtgtatactactgtaccgaagggacggggggaaccaggacggggtacgttaccaaggtaccttccg

SEQ ID NO: 532275 - DNA, 521 bp, Homo sapiens
  misc_feature: HEFZJCU01BSAZ5.17.25.C03.1.454.heavy.3.raw
  modified_base (504)..(504): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctccgtatagtatcaactgggtgcgccaggccgctggacaacgacctgagtcggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggccaagcggtcctttcggactttcngggggtccaggggaccg

SEQ ID NO: 532276 - DNA, 541 bp, Homo sapiens
  misc_feature: HEFZJCU01DQIQ1.53.10.A10.1.454.heavy.3.raw
  modified_base (483)..(483): a, c, t, g, unknown or other
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatcccgccctccgaggggggtaccgttttgggggtttccgaccccgtgggggcccgaggggaaccctggtccaccgtctcctcngcctccaccaagggcccatcggtccttcccctggccaccctcctccaagacgcacctc

SEQ ID NO: 532277 - DNA, 518 bp, Homo sapiens; identical to SEQ ID NO: 476173
  misc_feature: HEFZJCU01BAHF3.13.76.G10.1.454.heavy.3.raw

SEQ ID NO: 532278 - DNA, 531 bp, Homo sapiens
  misc_feature: HEFZJCU01BWNFM.10.85.H08.1.454.heavy.3.raw
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgaccaagaagtcactgtatctgcaaatgaacgatgtgagagtcgaggacacggctgtattatttctgtgcggagggggagccggctatgggtttcggacctcgtgggggcccaggggaacccttggtaccg

SEQ ID NO: 532279 - DNA, 485 bp, Homo sapiens
  misc_feature: HEFZJCU01CX0U0.7.10.A10.1.454.heavy.3.raw
  modified_base (448)..(448): a, c, t, g, unknown or other
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccggggtatcacttggatagaagtgcttattacattgactactggggccagggaaccctcgtcaccgtctcctcagcctccaccaagggcccatcggtcttccccctggcaccctcctccaagagcacctctgggggcacagcggcccnggggctgcctggtcaaggactacttcctagagacacg

SEQ ID NO: 532280 - DNA, 507 bp, Homo sapiens
  misc_feature: HEFZJCU01CUOXV.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgagggccgattcaccatctccagagacgattccaagaacacgttgtatcttcaatgaacagacctgacagtcgacgacacggccatgtatttttgtgcgagcgacccggggctcctcaatggctttcattacg

SEQ ID NO: 532281 - DNA, 511 bp, Homo sapiens
  misc_feature: HEFZJCU01CPE1R.40.81.H04.1.454.heavy.3.raw
tctagcgactcacgaccggtgctcgatttagtagtgtagattcgcggggatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggggtttgagtggatggggtggatcaaccctaccagaggtggcacaaagtatcgacagaactttcagggcagggtcaccatgacctgggacgcggtccatcagcacagtctacatggatctgagcggctgacctctgacgacacggccatgtattactgtggaagagacgttggtggcctaccggcggggctgaccactcggggccaggggtaacccg

SEQ ID NO: 532282 - DNA, 517 bp, Homo sapiens
  misc_feature: HEFZJCU01D2EM8.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacgta

SEQ ID NO: 532283 - DNA, 527 bp, Homo sapiens
  misc_feature: HEFZJCU01AP8MI.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaataatggaccctgtggacacagccacatattactgttcacgctctatggttcggggagttattagtccctactttgactactggggccgaggggaactctggtctaccggtctccgcaggcctcctaccaacgggccccattcc

SEQ ID NO: 532284 - DNA, 501 bp, Homo sapiens
  misc_feature: HEFZJCU01DF353.9.76.G10.1.454.heavy.3.raw
tgatacgtctcacgaccggtgctcgatttagtcactcatacaggggggagaggagcccagcactagaagtcggcggtgtttccattcggtgatcagcactgaacacaaaggactcaccatggagtttgggctgaactgggtttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcaggggactggagtgggtggcacttatatcatatgatggaattaaaaatactatgcagactccgtgaagggccgattcaccatctccagagacaactaccaagaacacgctgtttctgcaaatgaacagcctgagagctgaggacacggctgtgtatttctgtgctcaagataggtggacttcgattcttggagtggtcc

SEQ ID NO: 532285 - DNA, 497 bp, Homo sapiens
  misc_feature: HEFZJCU01A28FV.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgccgtacggcagcggtcttt

SEQ ID NO: 532286 - DNA, 483 bp, Homo sapiens; identical to SEQ ID NO: 444639
  misc_feature: HEFZJCU01EKEGF.11.23.C01.1.454.heavy.3.raw

SEQ ID NO: 532287 - DNA, 507 bp, Homo sapiens
  misc_feature: HEFZJCU01BXQMH.14.25.C03.1.454.heavy.3.raw
cgtctagtaccacgaccggtgctcgatttagtagtgtagatttgggtttgggtgcccaagctgctggagggcacggtcaccacgctgctgagggagtagagtcctgaggactgtaggacagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtgggtggtagtctgctataactggatcgacccgtgggccagggaaccctggtcaccgtctcctcacgcctccaccaacgggcccatcggtccttccccgtggcctacccgt

SEQ ID NO: 532288 - DNA, 523 bp, Homo sapiens
  misc_feature: HEFZJCU01ELIXE.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatggtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaagggacaatggtcaccgtctcttcagcctccaccaacgggcccatcggtccttcccctcggccaccctcctccaagacgccacctcgtgggggacacagcggtccc

SEQ ID NO: 532289 - DNA, 511 bp, Homo sapiens
  misc_feature: HEFZJCU01CTDH9.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccgaacataaacaaagacggaagtcagaaaactatgtggactctgtgaacggccgattcaccatctccagagacaacgccaagaattcactgtatttgcaaatgaacagcctgagaggcgaggacacggccgtgtattatgtgcgcgagatgatagtagactctacagtagcaggtggta

SEQ ID NO: 532290 - DNA, 529 bp, Homo sapiens
  misc_feature: HEFZJCU01BR8H1.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactagtacgaagggaggggggaaccgagcgggagttcccaagtacctacctttgacgtctc

SEQ ID NO: 532291 - DNA, 512 bp, Homo sapiens
  misc_feature: HEFZJCU01BMIHX.11.71.G05.1.454.heavy.3.raw
  modified_base (475)..(475): a, c, t, g, unknown or other
  modified_base (488)..(488): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagccggaggacacggcccgtatactttctgttcgacgaaacgngtacgggcaattntaggtgccttacgaccgtggggta

SEQ ID NO: 532292 - DNA, 515 bp, Homo sapiens
  misc_feature: HEFZJCU01B0Q4R.7.28.C06.1.454.heavy.3.raw
  modified_base (399)..(399): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccagagacaacgccgacaactnactgtctctgctgatgagcagcctgagagccgacgacacggctatctattactgtgcgaaactctcattccgttcatctgaatcgtaggggccacggggaaccctggtccgtcccg

SEQ ID NO: 532293 - DNA, 534 bp, Homo sapiens
  misc_feature: HEFZJCU01ASWR6.8.33.C11.1.454.heavy.3.raw
ctcgcgtgtccacgaccggtgctcgatttagagtgagctcgttggggtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccagggtaccctggtcaccgtctcctcagcctccaccaagggcccatcggtcttcccctggcgccctgctccaggacgcacctccgagagcacac

SEQ ID NO: 532294 - DNA, 523 bp, Homo sapiens
  misc_feature: HEFZJCU01BC1YI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccacgcctccaccaagggcccatcggtcttccccctggcg

SEQ ID NO: 532295 - DNA, 378 bp, Homo sapiens
  misc_feature: HEFZJCU01EOFVM.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgctggtcaaggactacttcctacgtgagct

SEQ ID NO: 532296 - DNA, 508 bp, Homo sapiens
  misc_feature: HEFZJCU01BNZMD.48.81.H04.1.454.heavy.3.raw
agtatacatacacgaccggtgctcgatttagtagtgtagattcgcgggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgaggcggcctgacgacctgagggacacggccatttactactgtgcggcgggggaggtgggacggagctcggtttcggagttatcatctactactttg

SEQ ID NO: 532297 - DNA, 486 bp, Homo sapiens; identical to SEQ ID NO: 448316
  misc_feature: HEFZJCU01EP4MB.3.48.E04.1.454.heavy.3.raw

SEQ ID NO: 532298 - DNA, 493 bp, Homo sapiens
  misc_feature: HEFZJCU01CTJ3C.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcctttgaccaggtgggccgacgggaacctggtcaccgtctcctcagcttccaccaacggccatcgtctcccctcggcgcctgctcagagcactcgt

SEQ ID NO: 532299 - DNA, 493 bp, Homo sapiens
  misc_feature: HEFZJCU01DZILN.13.86.H09.1.454.heavy.3.raw
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgaacacggccgtgtattattgtgcgagagtggagtggcagtggatatcgacaaattactaa

SEQ ID NO: 532300 - DNA, 512 bp, Homo sapiens
  misc_feature: HEFZJCU01AKBAF.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatctacaaatgaacagcctgagagtcgaggacacggctgtatattaactgtgcgagagatgtgtacgtcttttagatatctggggaccg

SEQ ID NO: 532301 - DNA, 502 bp, Homo sapiens
  misc_feature: HEFZJCU01AZ37A.17.10.A10.1.454.heavy.3.raw
cgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaattgttttctgtcatcgtaacatttgataggctctatggactggacttcgtc

SEQ ID NO: 532302 - DNA, 515 bp, Homo sapiens
  misc_feature: HEFZJCU01AJYMO.53.34.D01.1.454.heavy.3.raw
cgcgtatacacacgaccggtgctcgatttagatcgtctgtgttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaacgggccgagttcaccatctccagacacaattccaagaacacactgtttcttcaaatggacttcctgagaactgaggacacggccgtgtattactgcgcgagagtgcatgatagtggtttaccatgatcgtcttttgatt

SEQ ID NO: 532303 - DNA, 541 bp, Homo sapiens
  misc_feature: HEFZJCU01DIA2N.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccaggggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgtgtttattggggccaggggagcccgtggtcctaccg

SEQ ID NO: 532304 - DNA, 490 bp, Homo sapiens
  misc_feature: HEFZJCU01C4HLZ.40.22.B11.1.454.heavy.3.raw
tctagcgactcacgaccggtgctcgatttagacgacagctcagggggctctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtaccatatactacgcagactctgtgaagggccgattcaccatctccagagacaatgccaagaactcactgtatctgcaaatgaacagcctgagagacgaggacacggctagtatattactgtgcgagagacgccaggtggctact

SEQ ID NO: 532305 - DNA, 508 bp, Homo sapiens
  misc_feature: HEFZJCU01DZSFU.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggtttttccttgttgctattttagaaggtgtccaatgtgaggtgcagctggtggagtctgggggagggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgcccaagaactcactgtctctgcaaatgaacagcctgaggagtcgaggacacggctgtgtattactgttgcgagagatccggagggggacgtaatggacc

SEQ ID NO: 532306 - DNA, 526 bp, Homo sapiens
  misc_feature: HEFZJCU01B8GI0.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctgggagtgggtggccaatatacagtcaggtggaggtacgatacactatctcgactctgtgaagggcggttcaccatctccagagacaacgccaagaattcactgtatctgcaaatgaacagcctgagagtcgaagacgacgggtatttagttattgtgtgcgagatctggatttccttcgaaatgaagtgtggttcgatgtgtttgattc

SEQ ID NO: 532307 - DNA, 526 bp, Homo sapiens
  misc_feature: HEFZJCU01C6H4S.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgtcagataaccaaccttcaacctgacgacactgccgtttatttttgtacgagagcgtcgtctgtcagtgggaattgactactcgggccgagggaccgtgtcgaccgtctcctctacgcct

SEQ ID NO: 532308 - DNA, 531 bp, Homo sapiens
  misc_feature: HEFZJCU01DTKFG.51.15.B04.1.454.heavy.3.raw
cgatcgtatacacgaccggtgctcgatttagacagtatatatccgcgggggtctcagagaggagccttagccctggactccaaggcctttccacttggtgatcagcactgagcacagaggactcaccatggagttggggctgagctgggttttccttgttgctatttttagaaggtgtccaatgtgaggtgcacctggtggagtctgggggaggcttggtccagccgggggggtccctgagactctcctgtagagcctctggattcacctttagtaacttctggatgagctgggtccgccaggctccagggaaggggctggagtgggtggccaacataaacaaagatggaggtgagaagtactatgtggactctgtgaaggccgattcaccgtctccagagacaacgccaagaactcactgtatctgcaaatgacagcctgagaaccagggacacggccctgtattactagtgcgagacgacgggtcaaaacaactttggttcgggaaagactcctggggccaggggacct

SEQ ID NO: 532309 - DNA, 488 bp, Homo sapiens
  misc_feature: HEFZJCU01EN26X.3.48.E04.1.454.heavy.3.raw
  modified_base (238)..(238): a, c, t, g, unknown or other
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctnagactctcctgtgcagcgtctggattcagtttcgctacacatggcatgcactgggtccgccagtctccaggcaagggggctgcagtgggtggcgtttattcgaagcgatgggactcatgaacaatatgcagactccgtgaagggccgattcatcatctccagagacaactccaacaacacactggatctccaaatgaacagcctagagagtcgaggacacggcctatattattgtgcccttgatttacta

SEQ ID NO: 532310 - DNA, 499 bp, Homo sapiens; identical to SEQ ID NO: 462318
  misc_feature: HEFZJCU01C8ZWU.11.27.C05.1.454.heavy.3.raw

SEQ ID NO: 532311 - DNA, 444 bp, Homo sapiens; identical to SEQ ID NO: 453622
  misc_feature: HEFZJCU01AGS71.3.86.H09.1.454.heavy.3.raw

SEQ ID NO: 532312 - DNA, 511 bp, Homo sapiens
  misc_feature: HEFZJCU01DX8UG.19.86.H09.1.454.heavy.3.raw
tactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccacctgagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcgagggccgcgtcaccatggccaaggtcgcgtccacgaatacagtgtatagtggtacttgagcagcctgaggtctgacgacacggccatgttattatttggtgtcggaaggcgagggacgggggactaaggcaataaagtggttccgg

SEQ ID NO: 532313 - DNA, 510 bp, Homo sapiens
  misc_feature: HEFZJCU01EVVA0.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactctggggctgggaactctggtcaccgtct

SEQ ID NO: 532314 - DNA, 517 bp, Homo sapiens
  misc_feature: HEFZJCU01DPVC1.49.57.F02.1.454.heavy.3.raw
agtcgagagacacgaccggtgctcgatttagctcgatatagttgggtttggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctcgagtatgtca

SEQ ID NO: 532315 - DNA, 533 bp, Homo sapiens
  misc_feature: HEFZJCU01C1NP0.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccctgggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatctcaaatgaataacctgagagccgaggacacggccatgtattactgtgtggggcatttacttgacccctggggcccgggggaaccctggtccaccgtctccccaccctccaccg

SEQ ID NO: 532316 - DNA, 513 bp, Homo sapiens
  misc_feature: HEFZJCU01CN4CI.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatgggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttccccctggcaccctcctccagagcacctctgggggcacagtcggccctgggctgcctggtcaaggactacttccgtactacg

SEQ ID NO: 532317 - DNA, 541 bp, Homo sapiens
  misc_feature: HEFZJCU01DBVYB.17.28.C06.1.454.heavy.3.raw
  modified_base (526)..(526): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgtgtttagttggggccaggggacnccccgtggtccaccg

SEQ ID NO: 532318 - DNA, 551 bp, Homo sapiens
  misc_feature: HEFZJCU01DQB9U.7.70.G04.1.454.heavy.3.raw
  modified_base (528)..(528): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagccacccggggaagggcctggagtggattggatacatctattactttgggagcacctactacaacccgtccctcaagagtcgagtaacgatctcagtggacacgtctaaacaatcacctctccctgaggctgagctctgtgacagccgcggacacgggcgtttattactgtgcgaaggagggacgggacttacggtcgtacgtacgttgggggtttcgacccccgttgggggcccgacggggaacccgtggtaccnccgtctccgtcagcctccaaccg

SEQ ID NO: 532319 - DNA, 519 bp, Homo sapiens
  misc_feature: HEFZJCU01DFV0U.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatccctccgcagtcgacactttgattactggggccggggaaccctggtcgccgtctcctcagcctccaccaagggcccatcggtcttccccctcggcaccctcctccaagagcacctctgggggcacagcggccctgggctgcctggtcaaggactacttccagacgtatca

SEQ ID NO: 532320 - DNA, 507 bp, Homo sapiens
  misc_feature: HEFZJCU01A020A.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctcggcgccctgctccaggagcacctccgagaggcacagccggcccgtcgggctcgcctcggtcaaggactacttcctacgtcgtat

SEQ ID NO: 532321 - DNA, 497 bp, Homo sapiens
  misc_feature: HEFZJCU01CCVSD.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctcccgagagcacagcggccctgggctcgcctggtcaaggactacttccctacagtgct

SEQ ID NO: 532322 - DNA, 524 bp, Homo sapiens
  misc_feature: HEFZJCU01CWY37.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgacaaatgaacaccctgcgagccgaggacacggccgtatattactgtgcgagaattaacccgttcgcctggtttattaccg

SEQ ID NO: 532323 - DNA, 482 bp, Homo sapiens; identical to SEQ ID NO: 444503
  misc_feature: HEFZJCU01CPUN9.7.10.A10.1.454.heavy.3.raw

SEQ ID NO: 532324 - DNA, 527 bp, Homo sapiens
  misc_feature: HEFZJCU01B51LM.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttatttttaggaccagctgttaaaaactcctactaacggtctggacgtcgtggggtccgacggggaccgaac

SEQ ID NO: 532325 - DNA, 510 bp, Homo sapiens; identical to SEQ ID NO: 455775
  misc_feature: HEFZJCU01A3F8J.4.33.C11.1.454.heavy.3.raw

SEQ ID NO: 532326 - DNA, 533 bp, Homo sapiens
  misc_feature: HEFZJCU01ALCWW.16.27.C05.1.454.heavy.3.raw
  modified_base (526)..(526): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagacctccggggaggccgattcaccgtctccagagacaattccaagaacagggttgtttctccaagtgattgatctgagaagtgaggacacgggcttagttttattactgtgcgcggtggctgaccgctcttgactacgcggggccggggacgccccgggtnatcgtct

SEQ ID NO: 532327 - DNA, 541 bp, Homo sapiens
  misc_feature: HEFZJCU01A4CII.12.55.E11.1.454.heavy.3.raw
atacgacgtacacgaccggtgctcgatttagcactcgcacgtttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaagggctggaatgggtggcagttatatcatatgatggaagctatcaatattacgcagattctgtgaagggccgactcaccatctccagagacaattccagaaacaaactgtatcttcaaataaacagtctgagacttgaggacaggctgtctattactgtgcgagagactacggtgaccttttctggtatttcgatctctggggccgtggcaccctggtcactgtctcctcggccttccaccaacgggcccatccggttccttcccccgtggccgtccccgtgtcctcccagggacgcctacctccgtggggggtccgaccacggccggtccc

SEQ ID NO: 532328 - DNA, 502 bp, Homo sapiens
  misc_feature: HEFZJCU01C2MEU.11.71.G05.1.454.heavy.3.raw
  modified_base (446)..(446): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagntgaggacacggctggtgtattacgtgtgcgaaagatttctatagaggtgacgttac

SEQ ID NO: 532329 - DNA, 510 bp, Homo sapiens
  misc_feature: HEFZJCU01C30BT.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagagacacggctgtatataactgtagcgcgaggaccttattattatggttctaggggacctattgtacgtacgtcgggggaccaaggggaaccctggtaccgaccgtcctcctca

SEQ ID NO: 532330 - DNA, 489 bp, Homo sapiens
  misc_feature: HEFZJCU01B7MG7.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagacctgagagtcgaggacacggccgtatattattgtgcccgttgattacta

SEQ ID NO: 532331 - DNA, 484 bp, Homo sapiens; identical to SEQ ID NO: 446564
  misc_feature: HEFZJCU01BPQ73.19.13.B02.1.454.heavy.3.raw

SEQ ID NO: 532332 - DNA, 506 bp, Homo sapiens; identical to SEQ ID NO: 464888
  misc_feature: HEFZJCU01ETTR3.4.81.H04.1.454.heavy.3.raw

SEQ ID NO: 532333 - DNA, 515 bp, Homo sapiens
  misc_feature: HEFZJCU01DHIRD.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagacctaagtcctgagacgacgggtgtatactactagtacgaaggaggggggaaccagcgggagttccaagtactcctttgacgtctgggg

SEQ ID NO: 532334 - DNA, 490 bp, Homo sapiens
  misc_feature: HEFZJCU01BIDCH.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggtttttcctcgttgctcttttaagagatgtccagtgtcagatgcagatggtggagtctgggggaggcgtggtccggcctggggggtccctgagactctcctgttctgcgtctggattcatctttagtaaatctggcatgtcctggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacggggtgtttattactgttgggagaaatcctagtggcatc

SEQ ID NO: 532335 - DNA, 536 bp, Homo sapiens
  misc_feature: HEFZJCU01CZ41L.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggcacgggcttctacttctgtgcgaggagtaattactataacactgctcctttttacaccttcccttgacctttctggggtccatcggaaccccggtcaccggtt

SEQ ID NO: 532336 - DNA, 507 bp, Homo sapiens
  misc_feature: HEFZJCU01BRVCW.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcacccttcagtagttatagcatgaactgggtccgccaggctccagggaaggggctggagtgggtctcatccattagtagtaatagtgcctacagatactacgcagactcactgaagggccgactcaccatcctccagagacaacgccaagaactcactcgtatctgcaaatgaacagcctgagagccgaggacacggctgtgtattactgtgcgagaggagctattatcgtggaaccccgatcgt

SEQ ID NO: 532337 - DNA, 519 bp, Homo sapiens
  misc_feature: HEFZJCU01AX3W6.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgcccgcagacacggccgtgtattactgtgcgagactggccgcaacagactacggtggcaacgtcctatggtcttttgacttagtcttgggggcccaagggggaccaaattc

SEQ ID NO: 532338 - DNA, 401 bp, Homo sapiens
  misc_feature: HEFZJCU01DV2O6.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctcccaggagcacctccgagagcacagcggccctgggctgcctggtcaaggactacttcctacgtgagct

SEQ ID NO: 532339 - DNA, 569 bp, Homo sapiens
  misc_feature: HEFZJCU01DWTPQ.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtcgaccgtctcctcagcctccactacggacggaccgtacgttcgttaccccttcccgtcggcccgccgtcgtcctaccggaacggtacgacctacccgtaccgaggtacgaccgacgacggtcccggtccggtcc

SEQ ID NO: 532340 - DNA, 521 bp, Homo sapiens
  misc_feature: HEFZJCU01CLQPB.22.73.G07.1.454.heavy.3.raw
  modified_base (511)..(511): a, c, t, g, unknown or other
acatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactgggagtggattggggtatatctattacactgggagcaccgactacacgcccctccctcatgagtcgagtcaccatttcactagacacgtccaagaaccagttctccctgaaactgaggtctgtgaccgctgcggacacggccgtctattactgtgcgagatttgctttttggagttggttacgccgtcgtttgactactggggccgagggaaccctggtcaccgtctcctcancctccaccac

SEQ ID NO: 532341 - DNA, 489 bp, Homo sapiens
  misc_feature: HEFZJCU01BU7M3.17.39.D06.1.454.heavy.3.raw
cgtagactagcacgaccggtgctcgatttagtgacatctcgcagttctttgggggggagaggagcccagcactagaagtcggcggtgtttccattcggtgatcagctctgagcacagaggactcaccatggagtttgggctgagctgggttttcctcgtcgctcttttcagaggtgtccagtgtcaggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatgtggtatgatggaagtaatcaatactatgtagactccgtgaagggccgattcaccatctccagagacaattccaagaacacgctgtatctgcaaatgaacagcctgagagtcgaggacacgggctgtgtactactgtgcgagaggtctcgggt

SEQ ID NO: 532342 - DNA, 467 bp, Homo sapiens; identical to SEQ ID NO: 445004
  misc_feature: HEFZJCU01CT2ZR.16.78.H01.1.454.heavy.3.raw

SEQ ID NO: 532343 - DNA, 508 bp, Homo sapiens
  misc_feature: HEFZJCU01BB6ML.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccacgtccacgctggttcgacctcgtggggccac

SEQ ID NO: 532344 - DNA, 504 bp, Homo sapiens
  misc_feature: HEFZJCU01D0NLL.47.85.H08.1.454.heavy.3.raw
  modified_base (420)..(420): a, c, t, g, unknown or other
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctnctccaggagcacctccgacgagcacacgcggcccgtcggggcgtgccgtcggtcaacggactacttcctacgtcgagctctgac

SEQ ID NO: 532345 - DNA, 512 bp, Homo sapiens
  misc_feature: HEFZJCU01BEF2S.48.34.D01.1.454.heavy.3.raw
  modified_base (472)..(472): a, c, t, g, unknown or other
agtatacatacacgaccggtgctcgatttagatcgtctgtgttgggtttgggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgngaggcgtccgagttaacacgccgtcgggagggatagttta

SEQ ID NO: 532346 - DNA, 482 bp, Homo sapiens
  misc_feature: HEFZJCU01DFBWG.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctgtcaccgtctcctcagcctccaccaagggcccatcggtcttccccctggcaccctcctccaagagcacctctgggggcacagcggccctgggctgcctggtcaaggactacttcctagagacacg

SEQ ID NO: 532347 - DNA, 523 bp, Homo sapiens
  misc_feature: HEFZJCU01AX6G8.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggggccgattcgaccatctccagagacaattccaagaacacgctgtttcttcaaatgaacagcctgagagccgatgacacggccgtgtattactgtgcgagagatggggcccacgaacgttactacgctatggacgtctggggccgaagggtaccg

SEQ ID NO: 532348 - DNA, 490 bp, Homo sapiens
  misc_feature: HEFZJCU01C1SMQ.51.37.D04.1.454.heavy.3.raw
  modified_base (442)..(442): a, c, t, g, unknown or other
cgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaaggggctgcagtgggtctcacatattagtgctaatgggagaaccacattctacgcagactctgtgaagggccgattctccatctccagggacaacgccaagaactcactgtatctgcaaatgaacagtctaagngccgaagacacggccgtgtacttctgtgcgagtgtgggagaggactac

SEQ ID NO: 532349 - DNA, 501 bp, Homo sapiens
  misc_feature: HEFZJCU01DL3KW.51.1.A01.1.454.heavy.3.raw
cgatcgtatacacgaccggtgctcgatttagacgtctcatcaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctggggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacaggctgtgtattattgtgcgaaacttaatacgacggaggacaacggtaccgg

SEQ ID NO: 532350 - DNA, 489 bp, Homo sapiens
  misc_feature: HEFZJCU01B6JLQ.3.75.G09.1.454.heavy.3.raw
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagagagggtttcgcagctcgtccggcgggcccgagttcgaacatgactatcactactacc

SEQ ID NO: 532351 - DNA, 509 bp, Homo sapiens
  misc_feature: HEFZJCU01A0ITR.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatcggagttgaggagcctgacatctgacgacacggccgtactattactgtgcgagagtcccacgatccggtgagcctacggcagcggtcctttgacctttcgtc

SEQ ID NO: 532352 - DNA, 474 bp, Homo sapiens
  misc_feature: HEFZJCU01AQ4FW.49.8.A08.1.454.heavy.3.raw
agtcgagagacacgaccggtgctcgatttagcatactctacaggggtgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattcgagaacacgctgtatctgcaatgaacagctgagacctgagacacggctctcttttactgttgcgcaggaagca

SEQ ID NO: 532353 - DNA, 526 bp, Homo sapiens
  misc_feature: HEFZJCU01DWLXU.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggttgggacgacattctacggagactccatgggagggccgattcaccatctccagagacttttctcagaacacactgtctcttcaaatgaacagcctgagggccgaggacacgggccgtctattattgtgtgagagttttatgggcgagtgggctgggtaggacaggatcacgtgggggccaac

SEQ ID NO: 532354 - DNA, 525 bp, Homo sapiens
  misc_feature: HEFZJCU01CKGYF.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctatttttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatgggggcccacgaacggttactaacgtctatggacgtcgtggggccaaggggacccg

SEQ ID NO: 532355 - DNA, 527 bp, Homo sapiens
  misc_feature: HEFZJCU01DTW98.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctcagagacaacgccaagaattcactgtatctacactgaacagcctgagagtcgcagaccacggccgtagtattactgtgcgagatggtaggaaaaagtatggcttgtgtttattggggccagggagcc

SEQ ID NO: 532356 - DNA, 497 bp, Homo sapiens
  misc_feature: HEFZJCU01CB3MJ.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagtagccgaggacacggccgtatattacgtgtgcgaaagagtttaggggaatgaccgacgtc

SEQ ID NO: 532357 - DNA, 503 bp, Homo sapiens
  misc_feature: HEFZJCU01B3O3E.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacaggagtcaccatgaccacagacacatccacgagcacagcctacatggagctgaggagcctgagatcctgacgacacggcctgttattactgtgcgagaggttttaggtgattacttattgtagtgggtggtaccttgcttactttttc

SEQ ID NO: 532358 - DNA, 531 bp, Homo sapiens
  misc_feature: HEFZJCU01D5N56.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagaggacggactacggtgactactgggggttcgaccccgtggggaccaggggaacccgtggtcaccgtctcctcacgtcctccaccg

SEQ ID NO: 532359 - DNA, 518 bp, Homo sapiens
  misc_feature: HEFZJCU01BI5B4.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaactgggtgcgccaggccgctggacaacgacctgagtggatgggatgggcgaacccaacactggtgtcacagtgtcttcacccatcctccgggacagacttaccatgacccacgaactccctccataaacacagcctacatggagttgaggagcctgacatactgacgacaaccggccgtctattactgtgcgagagtcccacgactccggtgacgcctacggcagcggccctttgactttcgtggggccagggacg

SEQ ID NO: 532360 - DNA, 489 bp, Homo sapiens
  misc_feature: HEFZJCU01APQW4.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaagggcttgagtggatgggatgggtcaatcctaacagtggcggcagcggtctcacagaatatgcacagaagtttcagggcagggtctccatgaccagggacagggccagtcaagaacagcctacactggagctgaacagactgacatctgacgacacggccgtttattattgtggtgagaggaggacccga

SEQ ID NO: 532361 - DNA, 502 bp, Homo sapiens
  misc_feature: HEFZJCU01EGTP1.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtactaatttgataggctctatggactggacttgtc

SEQ ID NO: 532362 - DNA, 521 bp, Homo sapiens
  misc_feature: HEFZJCU01EGSGI.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctggagggcagttgttcaatggtatgctgacgccgtgaagggccgattcacatctccagagacaactccaggaacaacaatgtatttggacctgaacagcctaagtcctgaggacacgggtgtatactactgtacgaagggaggggggaaccgaggcgggagttccaagtactcctttg

SEQ ID NO: 532363 - DNA, 504 bp, Homo sapiens
  misc_feature: HEFZJCU01C3XG6.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgacaaatgaacagcctgagagctgaggacacggctggtgtattactgtgcgaaagatttctataggtaggtggactac

SEQ ID NO: 532364 - DNA, 516 bp, Homo sapiens
  misc_feature: HEFZJCU01C6NDB.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacgggccgtatattactgtgcgagacatgacttcggtgacccctggggccagggaccctggtcacgtctcctc

SEQ ID NO: 532365 - DNA, 502 bp, Homo sapiens
  misc_feature: HEFZJCU01EXR74.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggaactggacttctc

SEQ ID NO: 532366 - DNA, 371 bp, Homo sapiens; identical to SEQ ID NO: 444435
  misc_feature: HEFZJCU01DE7S1.3.42.D09.1.454.heavy.3.raw

SEQ ID NO: 532367 - DNA, 504 bp, Homo sapiens
  misc_feature: HEFZJCU01D52TB.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaacatgaccgagggagacgtccgtcaggacagcctatatggaggtgaccagcctgacgccctgacgacaccggcatatatttctgtgcgcgaggaatttcgacttctggaataattacttggggttagaacgtta

SEQ ID NO: 532368 - DNA, 527 bp, Homo sapiens
  misc_feature: HEFZJCU01CULVS.12.55.E11.1.454.heavy.3.raw
atacgacgtacacgaccggtgctcgatttagcactcgcacgttgggtttggggggaggcgtggtccggcctgggacgtccctgacactctcctgtgcagccgctggattcaccttacccagttatgctatgcactgggtccgccaggctccagggaaggggctggaatggggtggcagttatatcatatgatggaagctatcaatattacgcagattctgtgaagggccgactcaccatctccagagacaattccagaaacaaactgtatcttcaaataaacagtctgagtacttgaggacacggctgtctaattactgtgcgagagactacggtgaccttttctgtatttcgatctctggggccgtggcaccctggtcactgtctcctcggcttccaccaagggcccagtcggtcttccccctggccgccctcgtcctccagggtaacgcgacctcgtcgggggccgacgacgcggccccgtcgggcgtcgtcctggtcacgggactaccgttcctacgtacgtat

SEQ ID NO: 532369 - DNA, 472 bp, Homo sapiens
  misc_feature: HEFZJCU01CF8OQ.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacgagaagtttcagggcagggtcaccatgaccgagggacacgtccatcagcacgtccatcagcacagccctacacttcggacccttggaaggccggggcgttcgggccgaaacggggccg

SEQ ID NO: 532370 - DNA, 523 bp, Homo sapiens
  misc_feature: HEFZJCU01EVR4G.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtctggggaccaagggaaccg

SEQ ID NO: 532371 - DNA, 495 bp, Homo sapiens
  misc_feature: HEFZJCU01AMOFJ.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctcagactctcctgtgcagcgtctggattcagtttcgctacacatggcatgcactgggtccgccagtctccagcaaggggctgcagtgggtggcgtttattcgaagcgatgggactcatgaacaatatgcagactccgtggaagggccgattcaatcatctccagagacaactccaacaacaacactggatctaccaaatgaacagcctgagagtcgaggacacgggccgtaattattattgtcgcccttgattactatagt

SEQ ID NO: 532372 - DNA, 543 bp, Homo sapiens
  misc_feature: HEFZJCU01DMPNM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcgttgttctgggggccgagggggacccgtcggtcatccgtctccccacgccctcccacccaacgggcccactcggtcttccccctcggccgcccgtcg

SEQ ID NO: 532373 - DNA, 496 bp, Homo sapiens
  misc_feature: HEFZJCU01BBJEY.21.40.D07.1.454.heavy.3.raw
  modified_base (464)..(464): a, c, t, g, unknown or other
tcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccagcctgggggggtccctgagactctcctgtgcagcctctggattcacctttagtagctattggatgagctgggtccgccaggctccagggaaggggctggagtgggtggccaacataaagcaagatggaagtgagacatactatgtggactctgtgaagggccgattcacatctccagagacaacgccaagagctcactgtatctgacaaatgaacagcctgagagtcgaggacacggctgngtattactgtgcggagagactcccctcggtat

SEQ ID NO: 532374 - DNA, 492 bp, Homo sapiens
  misc_feature: HEFZJCU01EFXHF.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtgggtttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacacgcctgagagctggaggacacggctgtgtatactgtgcaaagatttctat

SEQ ID NO: 532375 - DNA, 535 bp, Homo sapiens
  misc_feature: HEFZJCU01EL0LK.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggagcttggtacagccgggggggtccctgacactctcctgtgcagcctcaggattcattttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggggcctttcatgtctgggccaagggacgctggtcaccgtctcttcagcctccaccaaggcccatcgtcttccccctggcaccctcctccagagcacctctgggggcacagcc

SEQ ID NO: 532376 - DNA, 540 bp, Homo sapiens
  misc_feature: HEFZJCU01D2SA3.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacgggcttgtttattacgtgtgtcgcggtggctgaccgctcttgacttacgtgggggccggggacggccccggtcactccggtctccc

SEQ ID NO: 532377 - DNA, 349 bp, Homo sapiens
  misc_feature: HEFZJCU01E15F0.52.78.H01.1.454.heavy.3.raw
cgcagtacgacacgaccggtgctcgatttagtgtgagtagtttgggtttggggagggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcga

SEQ ID NO: 532378 - DNA, 506 bp, Homo sapiens
  misc_feature: HEFZJCU01CBSVM.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagactttcagggcagggtcaccatgaccacggacacgtccataagcacagtttacatggaggtaaataggctgagatctgacgacacggccgtatattactgtgcgttattaacggacgattacgattgttttgatttggtttttacg

SEQ ID NO: 532379 - DNA, 490 bp, Homo sapiens
  misc_feature: HEFZJCU01AWM5V.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggtttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcaagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgccttagatttacta

SEQ ID NO: 532380 - DNA, 504 bp, Homo sapiens
  misc_feature: HEFZJCU01DGW6V.52.34.D01.1.454.heavy.3.raw
cgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaccctagtagccgtctcctcagcctccaccaagggcccatcggtcttcccctggcaccctcctccaagagcacctctgggggcacagcggcctgggctgcctggtcaaggactacttcctatacgatcg

SEQ ID NO: 532381 - DNA, 508 bp, Homo sapiens
  misc_feature: HEFZJCU01A4FE1.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgccacccgtgaaaggcagattcagcatctcaagagatgattacaaaaagtacgctgtatctgaacatagaacagcctagaaaacggaggacacagccgtgtattactgtagccactcgaggaccgatattgtt

SEQ ID NO: 532382 - DNA, 400 bp, Homo sapiens; identical to SEQ ID NO: 444452
  misc_feature: HEFZJCU01B9XEW.47.24.C02.1.454.heavy.3.raw

SEQ ID NO: 532383 - DNA, 583 bp, Homo sapiens
  misc_feature: HEFZJCU01D43PY.49.10.A10.1.454.heavy.3.raw
agtcgagagacacgaccggtgctcgatttagcgtcgatctcaggggctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggctggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcaaatctccaaagactactccaagaatacggtgtatcttcaaatgaatggcctcgttttgcggtacacggctgtttattattgttgcgacgacgggggtcccccctttccgtacggtaggcggacgtacacgttaacctaaccttttacgtacccgtaccgtcgggggacccgtaacggggtaaccccgtacgggtaccg

SEQ ID NO: 532384 - DNA, 373 bp, Homo sapiens
  misc_feature: HEFZJCU01A0BWD.53.38.D05.1.454.heavy.3.raw
cgcgtatacacacgaccggtgctcgatttagtatctgatagttgggtttggggggagaggagcccagcactgggattccgaggtgtttccatttcggtgatcagcactgaacacagaggactcaccatggagttttggcttgagctgggttttccttgttgctattttaaaaggtgttccagtgtcgaggtgcagctggtggagtctggaggaggcttgggtccagccgtggggggtccctgaggactctcctgtgcacgcctctggattgaccgtcagtagcaactacatgacgctgggtcccgccagggcccccgagggaagggggctcgggaggtggggtcgtcaacgtaatttagtaggcggtggtagg

SEQ ID NO: 532385 - DNA, 475 bp, Homo sapiens
  misc_feature: HEFZJCU01CROIA.16.10.A10.1.454.heavy.3.raw
  modified_base (154)..(154): a, c, t, g, unknown or other
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagnggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctggggccagggaaccctggtcaccgtctcctcagcctccaccaagggcccatcggtcttccccctggcaccctcctccaagagcacctctgggggcacagcggcctgggctgcctggtcaaggactacttccgagtagtaca

SEQ ID NO: 532386 - DNA, 501 bp, Homo sapiens; identical to SEQ ID NO: 502905
  misc_feature: HEFZJCU01BK4CK.51.78.H01.1.454.heavy.3.raw

SEQ ID NO: 532387 - DNA, 513 bp, Homo sapiens
  misc_feature: HEFZJCU01A1AFK.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccgagggaacccgtggtcaccgtctcctcagcctccaccagggcccatcggtcttcccctgcaccctcctccaagagcacctctgggggcacagcggccctgggctgcctggtcaaggactacttccgtactacg

SEQ ID NO: 532388 - DNA, 508 bp, Homo sapiens
  misc_feature: HEFZJCU01ED515.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggcaccctcctccaagagcacctctgggggcacagcggcctggctgcctggtcaaggactacttcctacgtcgtat

SEQ ID NO: 532389 - DNA, 500 bp, Homo sapiens
  misc_feature: HEFZJCU01EJRHU.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaataggacgctatgccgacttcgtgaagggccgattcaccatctccagagactaattccaagaacacgcagtatctgcaaatgaacagcctgagagctggaggacgacggctgtgtattacgtgtgggagagagtgggaggtcgatattgta

SEQ ID NO: 532390 - DNA, 516 bp, Homo sapiens
  misc_feature: HEFZJCU01DNWY7.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccattcaccatctccagagacaactctaagaacacgctgtttcttcaaatgaacagcctgagagccgatgacacggccgtgtattactgtgcgagagagtgggggcccacgaacgttactacgctatggacgtcgtggggcc

SEQ ID NO: 532391 - DNA, 491 bp, Homo sapiens
  misc_feature: HEFZJCU01DOVY8.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgttattactgtgacgaaagatatcgcggt

SEQ ID NO: 532392 - DNA, 508 bp, Homo sapiens
  misc_feature: HEFZJCU01D19A0.48.55.E11.1.454.heavy.3.raw
agtatacatacacgaccggtgctcgatttagcactcgcacgttgggtttgggggctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccggggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaatgaacagcctgagaggacgaggacacggctgtttattactgtgcgtagagtggacggtatttcacctacacac

SEQ ID NO: 532393 - DNA, 513 bp, Homo sapiens
  misc_feature: HEFZJCU01BKCKZ.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggatccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtggaggggccgattcagcatctccagagacaacggcaagagtatactgtatctggaaatgaacaatctgagagtcgacgatacggctgtctatcattgtgttttcgattgcttcggtccgcgggacttctggggccgagggtaacccgg

SEQ ID NO: 532394 - DNA, 508 bp, Homo sapiens
  misc_feature: HEFZJCU01DA948.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggccaccctcctccaagagcacctctgggggcacagcggccctgggctgcctggtcaaggactacttccgagtagtaca

SEQ ID NO: 532395 - DNA, 524 bp, Homo sapiens
  misc_feature: HEFZJCU01EBGQ3.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcagagatgattcagagaactcactttatctgcaatgaacagcctgagaaccgacgacaccggccgtctacttattagttgtcatagaccgtaggataacaacgacggtgtaccgttggtatttc

SEQ ID NO: 532396 - DNA, 505 bp, Homo sapiens
  misc_feature: HEFZJCU01ASAV4.49.81.H04.1.454.heavy.3.raw
agtcgagagacacgaccggtgctcgatttagtagtgtagattcgcgggcacgaccggtgctcgatttagtagtgtagattccgcggggtctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatagaacagcctgagagctgaggacacggctatttatta

SEQ ID NO: 532397 - DNA, 536 bp, Homo sapiens
  misc_feature: HEFZJCU01DJIO2.9.70.G04.1.454.heavy.3.raw
  modified_base (347)..(347): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtggaccgcatctacaacccgtccctcaagngtcgagtcagcatgtcagtcgacacgtcccagaaccagtctccctgacagtgagttatatgaccgccgcagacacggccgtgtattactgtgcgagagaggccgttatttttaggaaccaggccttagttaaaaacctaccttactaccggttcgtggacgtcgttgggggcctaagggggacctaaac

SEQ ID NO: 532398 - DNA, 516 bp, Homo sapiens
  misc_feature: HEFZJCU01A1DTR.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgacaaatgaatagcctgagagccgacgacacggccatatattactgtgcgaaagcaccggcagttacgtcacccatacttactttgactacgtggggtaccg

SEQ ID NO: 532399 - DNA, 507 bp, Homo sapiens
  misc_feature: HEFZJCU01CG12B.11.27.C05.1.454.heavy.3.raw
  modified_base (295)..(295): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagactattatctcggaaccccgatgttcg

SEQ ID NO: 532400 - DNA, 496 bp, Homo sapiens
  misc_feature: HEFZJCU01B4RDD.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctggttttcctcgttgctctttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaacttccaagaacatggtgtatctgcaaatgaaccagcctgagagccgaggacacgggtagtttacttacttggtagggagtaaatccta

SEQ ID NO: 532401 - DNA, 525 bp, Homo sapiens
  misc_feature: HEFZJCU01EOY1N.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggcgtgtattactgtgcgagagatcgggggcccacgaaccgttactacgctagtggacgtcgtggggccgaagggaccg

SEQ ID NO: 532402 - DNA, 504 bp, Homo sapiens
  misc_feature: HEFZJCU01E1VCI.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggtttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgtcgcgacatgactacgtctcaattcgtgggg

SEQ ID NO: 532403 - DNA, 541 bp, Homo sapiens
  misc_feature: HEFZJCU01DULSX.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctggagagtcgcagacacggccgtgtattactgtgcgagatgtggaaaaagtaatggctgtgtttattggggccaggggacgtcccgtggtcgaccg

SEQ ID NO: 532404 - DNA, 542 bp, Homo sapiens
  misc_feature: HEFZJCU01EITNP.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggagttggggttttttttcgtttacgtacggg

SEQ ID NO: 532405 - DNA, 427 bp, Homo sapiens; identical to SEQ ID NO: 444708
  misc_feature: HEFZJCU01A1X6G.9.34.D01.1.454.heavy.3.raw

SEQ ID NO: 532406 - DNA, 509 bp, Homo sapiens
  misc_feature: HEFZJCU01D8DEC.10.38.D05.1.454.heavy.3.raw
  modified_base (408)..(408): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaanaacatcttgtatcttcacatgcacaatctagagagtcgacgacacggccaacctattattgtgcgcgacatgactacgctcaattctggggccaggggacg

SEQ ID NO: 532407 - DNA, 540 bp, Homo sapiens
  misc_feature: HEFZJCU01CP0VG.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggcagggaaccctggtgaccgtctcctcagcctccaccaagggcccatcggtccttcccctggccgccctcgcctccaggagcacctccggacgagccgacaggccggcccctcggggtccg

SEQ ID NO: 532408 - DNA, 507 bp, Homo sapiens; identical to SEQ ID NO: 446095
  misc_feature: HEFZJCU01EAX10.10.38.D05.1.454.heavy.3.raw

SEQ ID NO: 532409 - DNA, 521 bp, Homo sapiens
  misc_feature: HEFZJCU01DH7YN.48.35.D02.1.454.heavy.3.raw
agtatacatacacgaccggtgctcgatttagcacacgatagttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtgatcgacaccaacactgggaacccaacacatgcccggggcttcaaaggacggtttgacttctccttggccacctctgtcagcacggcatatctgcagatcagcagcctaaagcctgaggacactgccgtgttttattgtgcgagatccaggcgagggaggattaccgatttcttatatagcgactacctatacctttcggaatgggacg

SEQ ID NO: 532410 - DNA, 511 bp, Homo sapiens
  misc_feature: HEFZJCU01D3BA8.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtcccgtggggccagggaaccctcgtcaccgtctcctcacgcctccaccaaggcccatcgtcttcccctggccgtcccg

SEQ ID NO: 532411 - DNA, 501 bp, Homo sapiens
  misc_feature: HEFZJCU01C623S.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgagggcacggctgtttattactgtacgaaagaggggggatacagtggcagctccaagtactactttgacttctgggccagggaaccctggtcaccgtctcctcagcctccaccaagggccatcggtcttcccctggcgccctgctccagagcacctccgagagcacagcggccctgggctgcctggtcaaggactacttccagacgtatca

SEQ ID NO: 532412 - DNA, 483 bp, Homo sapiens; identical to SEQ ID NO: 444639
  misc_feature: HEFZJCU01CJVQP.11.23.C01.1.454.heavy.3.raw

SEQ ID NO: 532413 - DNA, 533 bp, Homo sapiens
  misc_feature: HEFZJCU01ECRHW.49.78.H01.1.454.heavy.3.raw
agtcgagagacacgaccggtgctcgatttagtgtgagtagtttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaacgggcccatcggtcttccccctggccgcctcgctccaggagcacctccgagagcacagcggcccg

SEQ ID NO: 532414 - DNA, 488 bp, Homo sapiens
  misc_feature: HEFZJCU01DA2TM.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatacgaagaaccagttctccctgcagctgacctcctgtgactcccgaggacacgggtggtatacttactgtggaagacggccccatacg

SEQ ID NO: 532415 - DNA, 499 bp, Homo sapiens
  misc_feature: HEFZJCU01C7YEZ.13.33.C11.1.454.heavy.3.raw
  modified_base (471)..(471): a, c, t, g, unknown or other
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacacgcctacatggaactgaggagcctaagatctgacgacacgccgtttatattgtgcaataagaaactncaaacgatgcttttgatatgtggggccg

SEQ ID NO: 532416 - DNA, 495 bp, Homo sapiens
  misc_feature: HEFZJCU01BE4N5.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcgagggtctccatgaccagggacagggccatcagaacagcctacatggagctgaacagactgacatctgacgacacggccgtttattattgtggtgagagacggacccgatgacctc

SEQ ID NO: 532417 - DNA, 538 bp, Homo sapiens
  misc_feature: HEFZJCU01EQ9A6.17.28.C06.1.454.heavy.3.raw
  modified_base (526)..(526): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctcagagacaacgccaagaattcactgtatctacaactgaacagcctgagagtcgcagacacggccgtgtattactgtgcgagatgtaggaaaaataagtggctgtgtttagttggggccaggggacncccgtggtcacg

SEQ ID NO: 532418 - DNA, 491 bp, Homo sapiens
  misc_feature: HEFZJCU01EN9Z8.40.83.H06.1.454.heavy.3.raw
tctagcgactcacgaccggtgctcgatttagatcacgtgcgtcgcggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccatgtctggtcggatgaaagttatgcatactatgcagacctctctgaggggccgattcatcatctctagagacaaattcgaaagaacacggcttatcttgcaaatgaacagcctgacagtcgaggacacggctgtatattttctgtgcgtaatgaagggtaac

SEQ ID NO: 532419 - DNA, 524 bp, Homo sapiens; identical to SEQ ID NO: 451870
  misc_feature: HEFZJCU01EP4N6.11.25.C03.1.454.heavy.3.raw

SEQ ID NO: 532420 - DNA, 497 bp, Homo sapiens
  misc_feature: HEFZJCU01D8J0K.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccacgtc

SEQ ID NO: 532421 - DNA, 527 bp, Homo sapiens
  misc_feature: HEFZJCU01AHIBC.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcggtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacatgtatttggaaatgaacagacctaagtcctgaggacgacgggtgtatactactgtacggaagggaggggggaaccgaggcgggagtccgaagtactcctttgacgtcgtggggccgtac

SEQ ID NO: 532422 - DNA, 435 bp, Homo sapiens
  misc_feature: HEFZJCU01DO37M.17.10.A10.1.454.heavy.3.raw
  modified_base (358)..(358): a, c, t, g, unknown or other
cgtagactagcacgaccggtgctcgatttagcgtcgatctcaggggacccaaaaaccacacccctccttgggagaatccctagatcacagctcctcaccatggactggacctggagcatcctttttcctggtggcagcaggcacaggtgcccacgcccaggttcagttggtgcagactggggctgaggtgcagaagcctggggcatcagtgactgtctctgcaaggccagtggatatatcttcacaaaatatggtatgaattgggtgcgacaggcccccggacaagggcttgagtgggtggggtggtcagcggctttgacggtaggcacagtatgcaccgaagagtgaagggctaagngtcacggattaccacggaccaccccgacgaacaccagtaccacgactagcctaactgacggacgcctggagaacgct

SEQ ID NO: 532423 - DNA, 505 bp, Homo sapiens
  misc_feature: HEFZJCU01BTW2J.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtggaagggccgattcaccgtctccagagacaattccaggcacacgctgtatctgcaaatgaacagcccgagagctgaggacacggctgtgtattactgtgtcgaaagatttctatagaggtgacgtacgggggcgtcgtttg

SEQ ID NO: 532424 - DNA, 515 bp, Homo sapiens
  misc_feature: HEFZJCU01C3AAL.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctcccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacggccgtgtattactgtgtgagagacatgacaacggtgagtaaccgggaggggtt

SEQ ID NO: 532425 - DNA, 510 bp, Homo sapiens
  misc_feature: HEFZJCU01CVNUR.51.40.D07.1.454.heavy.3.raw
  modified_base (487)..(487): a, c, t, g, unknown or other
cgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatagaaaagcctgagagctggagacacggctgtttattactgtgacgaattaancacggagacaaccggtacccccg

SEQ ID NO: 532426 - DNA, 520 bp, Homo sapiens
  misc_feature: HEFZJCU01BR4NZ.52.20.B09.1.454.heavy.3.raw
cgcagtacgacacgaccggtgctcgatttagtgtagtgtgaaggggggaagaggaagactgacggtccccccaggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggctcttttttactgtgcgccaggagcagtggctggcacatgatgcttttgatatctgagccaagggacaagtggtcatcgtctctcggcctccaccaacggcccatcggtccttccccg

SEQ ID NO: 532427 - DNA, 515 bp, Homo sapiens
  misc_feature: HEFZJCU01BUS9S.13.33.C11.1.454.heavy.3.raw
  modified_base (479)..(479): a, c, t, g, unknown or other
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccgatgaccacggacacgtccatcaacacagcctacatgaactgaggagcctaagatctgacgacacggccgtttattattagtgcaaataagaaattgcaaacgaatntcgttttgattatgtggggaccgaagggacctaacg

SEQ ID NO: 532428 - DNA, 534 bp, Homo sapiens
  misc_feature: HEFZJCU01CZFJY.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttctttcaaatgaacagcctgagagccgatgacacgggccgtgtattactgtgcggaggagagtcgggggcccaacggaaccgttaacgtacgcttaagtgggtacgtccgtgggggaccg

SEQ ID NO: 532429 - DNA, 509 bp, Homo sapiens
  misc_feature: HEFZJCU01EZ8DZ.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcaggggggctggagtggggtggcagttatttcatatgatggaaatagtgacttctattcagactccgtgaagggccgattcaccgtctccagagacaattccagggcacacgctgtatctgcaaatgaacagcctgagagctagaggacacggcttgtgttattactgttgacgaaagattttctatagaggtgacgtac

SEQ ID NO: 532430 - DNA, 482 bp, Homo sapiens
  misc_feature: HEFZJCU01DZUNJ.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggcctagggaaccctcgtcaccgtctcctcagcctccaccaggcccatcggtcttcccctggcaccctcctccaagagcacctctgggggcacagcggcccgtgggctgcctggtcaaggactacttcctagagacacg

SEQ ID NO: 532431 - DNA, 493 bp, Homo sapiens
  misc_feature: HEFZJCU01BQKN3.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggccctgttactttttgtcgtcgagagagtctattaaagtggcgttc

SEQ ID NO: 532432 - DNA, 514 bp, Homo sapiens
  misc_feature: HEFZJCU01CX4NP.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggacttggacctcgtacgacgactacggccatgtacttactgtggaaagaggtacgttggtgggtctaccggtccgggggctggaaccctacgt

SEQ ID NO: 532433 - DNA, 495 bp, Homo sapiens
  misc_feature: HEFZJCU01D4MF3.14.25.C03.1.454.heavy.3.raw
  modified_base (490)..(490): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtagggagagatggaggtcgaatnttgta

SEQ ID NO: 532434 - DNA, 506 bp, Homo sapiens
  misc_feature: HEFZJCU01CAGXQ.51.71.G05.1.454.heavy.3.raw
cgatcgtatacacgaccggtgctcgatttagtgtcgtcgcaagagagagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggccctggacaaggccttgagtggatgggaaagatcaaccctagtggtggtaccacaagttacgcccagaaattccagggcagagtctccatgacagaaatacgtccgcgaggacagtctacatggagttgagcagcctgagaactgacgacacggccatatattactgtgcgagagaccttgctggtccttttgtacttcgtggggccgagggaacccgttc

SEQ ID NO: 532435 - DNA, 495 bp, Homo sapiens
  misc_feature: HEFZJCU01C4VKL.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtggagaaatctagtggcac

SEQ ID NO: 532436 - DNA, 503 bp, Homo sapiens
  misc_feature: HEFZJCU01EVY2A.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcgagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtctatcgtacaatttgataggctctatggactggacttcgtc

SEQ ID NO: 532437 - DNA, 498 bp, Homo sapiens
  misc_feature: HEFZJCU01ERLU9.51.42.D09.1.454.heavy.3.raw
cgatcgtatacacgaccggtgctcgatttagacacatacgcagggaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggcgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgttatttttgtgttgagagtacgttttcggaactaatcctagacgacccctggtc

SEQ ID NO: 532438 - DNA, 506 bp, Homo sapiens
  misc_feature: HEFZJCU01B0NY4.13.55.E11.1.454.heavy.3.raw
tcacgtactacacgaccggtgctcgatttagcactcgcacgttgggtttgggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtctgggggaggcttggtccagccgggggggtcactgagactctcctgtacagctcgagattcattttcaggaattattggatgagttgggtccgccagtctccagggaagggctggagtgggtggccaacataaaggaggatgggagtcagacatattatgtggagtctgtgcggggccgattcaccatttccagagacaacgccagatcgtcagtatatctgcaaatgaggagcctgagagtcgatgagtacggctacatattattgtgcgagattagactagttttccagtacggcg

SEQ ID NO: 532439 - DNA, 530 bp, Homo sapiens
  misc_feature: HEFZJCU01DAU4I.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatccggtcttcccctggcgccctgctccaggagcacctccgagagcacagccggcccgtgggccg

SEQ ID NO: 532440 - DNA, 506 bp, Homo sapiens
  misc_feature: HEFZJCU01DJNZ4.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctggacgggcctgacatctagaagacacggctttatattactgtgcgcgagatggctggcacgaggaggcacaactggctcgacccc

SEQ ID NO: 532441 - DNA, 352 bp, Homo sapiens; identical to SEQ ID NO: 452555
  misc_feature: HEFZJCU01CX9YJ.49.4.A04.1.454.heavy.3.raw

SEQ ID NO: 532442 - DNA, 501 bp, Homo sapiens
  misc_feature: HEFZJCU01CHYOF.53.26.C04.1.454.heavy.3.raw
cgcgtatacacacgaccggtgctcgatttagtctagcgactttgggtttgggggcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcaggggcaggggtctccatgaccagggacagggccatcagaacagcctacatggagctgaacagactgacatctgacgacacggccgttttattattgtgtggagaggacgggacccgatgaccttcggg

SEQ ID NO: 532443 - DNA, 493 bp, Homo sapiens
  misc_feature: HEFZJCU01D8VK8.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagcccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagacgcacagcggccctgggctgcctggtcaaggactacttccgtatctctcg

SEQ ID NO: 532444 - DNA, 500 bp, Homo sapiens
  misc_feature: HEFZJCU01AKUED.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcaggggtcaccatgacctgggacgcgtccatcagcacagtctacatggatctgagcggactgacctctgacgacacggcatgtattactgtggaagagacgttggtggctaccggcgggctgaccacgtgggacc

SEQ ID NO: 532445 - DNA, 523 bp, Homo sapiens
  misc_feature: HEFZJCU01C2R2Y.51.17.B06.1.454.heavy.3.raw
cgatcgtatacacgaccggtgctcgatttagtcgatagtgaaggggcagtgactcctgtgccccaccatggacacactttgctccacgctcctgctgctgaccatcccttcatgggtcttgtcccagatcaccttgaaggagtctggtcctacactggtgaaacccacacagaccctctcgctgacctgcgccttctctgggttctcactcagcagtagtggagtgggtgtgggctggatccgtcagcccccaggaaggccctggagtgggttgcactcatttattggaatgatgaaagccgctacagcccatctctgaagagcaggctcaccatctcgaggggcaggtccgaaaaccaggtgatccttacgatgagtaacttggaccctgtggacacagccacatattactgtgcacacaggttcggcgtatttttggagttggttattcaaacccctacttcgacttcgtggggcccgggaagtccttggtcaccggtctcctcacgtcctcccaccaacc

SEQ ID NO: 532446 - DNA, 500 bp, Homo sapiens
  misc_feature: HEFZJCU01BZEV6.48.31.C09.1.454.heavy.3.raw
  modified_base (399)..(399): a, c, t, g, unknown or other
  modified_base (449)..(449): a, c, t, g, unknown or other
agtatacatacacgaccggtgctcgatttagacgtctcatcaaggaaggaaggggtctgagagaggagccttagccctggattccaaggcctatccacttggtgatcagcactgagcaccgaggattcaccatggaactggggctccgctgggttttccttgttgctattttagaaggtgtccagtgtgaagtacagctggtggagtctgggggaggcctggtcaagcctggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggcgattcgcatctcngagacaacgccaacaactcactgtttctgcagatggacaacctgagaggngaggacacggctgtatattactgtgtctcccatacatcgcagctcgtgacg

SEQ ID NO: 532447 - DNA, 518 bp, Homo sapiens
  misc_feature: HEFZJCU01BVEDU.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttaatctgcaaatagacagcctgagaccagacgacacggctgtctattattgcgcgagagagacacacgaacctactggccaatactatggggcttgttctggggccagggaccctggtcatcgtctccccagcctcaccaacggccatcggccttcccctggcg

SEQ ID NO: 532448 - DNA, 508 bp, Homo sapiens
  misc_feature: HEFZJCU01BN0N5.51.21.B10.1.454.heavy.3.raw
cgatcgtatacacgaccggtgctcgatttagtgtcgtcgcaagggggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggccctggacaaggccttgagtggatgggaaagatacaaccctagtggtggtaccacaagttacgcccagaaattccagggcagagtctccatgaccagaaatacgtccgcgaggacagtctacatggagttgagcagcctgagaactgacgacacggcatatattactgtgcgagagaccttgctggtccttttgactttctgggggccagggaccctggtccaccgt

SEQ ID NO: 532449 - DNA, 528 bp, Homo sapiens
  misc_feature: HEFZJCU01BI7BN.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtcttccccctggcgccctcgctccaggagcgacctccgacgacgcacacggcggccccgtcgggcgtcgg

SEQ ID NO: 532450 - DNA, 509 bp, Homo sapiens
  misc_feature: HEFZJCU01EJC0C.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctgaaaaccgaggacacggccgtgtattactgtgccagacatccgtcgtattacgtattttt

SEQ ID NO: 532451 - DNA, 481 bp, Homo sapiens
  misc_feature: HEFZJCU01EIM8E.49.38.D05.1.454.heavy.3.raw
agtcgagagacacgaccggtgctcgatttagtatctgatagttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaagggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtactattactgtgcga

SEQ ID NO: 532452 - DNA, 535 bp, Homo sapiens
  misc_feature: HEFZJCU01CKRQO.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactagctcctttttacaccttcccttgtacttctagggccacgtggaaccccggtccg

SEQ ID NO: 532453 - DNA, 504 bp, Homo sapiens
  misc_feature: HEFZJCU01CZX2X.10.71.G05.1.454.heavy.3.raw
catagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccacgcctgagaggccgaggacacgggtgtttattactggtggaagaatcctagtggcatcacctggttac

SEQ ID NO: 532454 - DNA, 498 bp, Homo sapiens
  misc_feature: HEFZJCU01BXDPZ.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaagatttctatagaggtgacgtacgggggcttcg

SEQ ID NO: 532455 - DNA, 528 bp, Homo sapiens
  misc_feature: HEFZJCU01CKIHK.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcattacttgaccctggggccggggaaccctggtccaccgtctccccaccctccaccg

SEQ ID NO: 532456 - DNA, 542 bp, Homo sapiens
  misc_feature: HEFZJCU01CTY5B.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtggaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgaccccgtggggccagggaaccctggtcaccgtctccctcacgcctccaccgaagggccccatccggtcctttccccctggccacccttccctccaaggaagccaccttc

SEQ ID NO: 532457 - DNA, 529 bp, Homo sapiens
  misc_feature: HEFZJCU01EIGCS.11.25.C03.1.454.heavy.3.raw
  modified_base (439)..(439): a, c, t, g, unknown or other
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctggttcaccgtcagtcacacctacatgagttgggtccgccaggctccagggaaggggctgggagtgggtctcctttatttacagcagtggtagtacatattccgcagactccgtgaggggccgattcaccatctccagagacaactctaagaacacgctgtttcttcaatgaacagcctgagngccgatgacacggccgtgtattactgtgtcgagagagtggggcccacgaacgttactacgctatggacgtcgtgggggccaagggaccac

SEQ ID NO: 532458 - DNA, 503 bp, Homo sapiens; identical to SEQ ID NO: 455209
  misc_feature: HEFZJCU01A4R3I.17.10.A10.1.454.heavy.3.raw

SEQ ID NO: 532459 - DNA, 538 bp, Homo sapiens
  misc_feature: HEFZJCU01BN0QU.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctgacaaggccttgagtggatgggaaggatcggtccctatcgttgacacaccaaactacgcacagaagttccagggcagactcaccataaccgcggacaaattaacgaacacagttaatactggagctgaacagcctgtcatctgaggacacgggcttctacttctgtgcgaggagtaattataataacactgcttcctttttacaccttcccttgacctttcgtggggccagtcggaccccggtaccg

SEQ ID NO: 532460 - DNA, 522 bp, Homo sapiens
  misc_feature: HEFZJCU01BNEFZ.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaagggatattatgcacctccgtgaagggccgattcagcatctccagagacatttccaaggccacggtgtatctgcaaatgaccagcctgagaagtgaggacacggctatgtactattgtgcgaaggaccttccacctagaaactaatagtaggggggtctttagaactacgtc

SEQ ID NO: 532461 - DNA, 519 bp, Homo sapiens
  misc_feature: HEFZJCU01D3M5F.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggctagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacggaaggaggggggaaccaggcgggagttccgaagttactcctttgacgtcgt

SEQ ID NO: 532462 - DNA, 492 bp, Homo sapiens
  misc_feature: HEFZJCU01A03TV.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtagcaataagaattgcaaacgatgctttgatatgtgggcc

SEQ ID NO: 532463 - DNA, 519 bp, Homo sapiens
  misc_feature: HEFZJCU01CDZ9T.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaaagggatattatgcgacctccgtgaagggccgattcagcatctccagagacatttccaaggccacggtgtatctgcaaatgaccagcctgagaagtgagacgacggctatgtactattgtgcgaaggaccttccacctgaaactaatatggggggtctttgaactagtc

SEQ ID NO: 532464 - DNA, 535 bp, Homo sapiens
  misc_feature: HEFZJCU01D529V.11.85.H08.1.454.heavy.3.raw
  modified_base (486)..(486): a, c, t, g, unknown or other
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcancctccacaaggcccatcggtcttcccctcggccaccctcctccaagacg

SEQ ID NO: 532465 - DNA, 533 bp, Homo sapiens
  misc_feature: HEFZJCU01CT868.49.70.G04.1.454.heavy.3.raw
agtcgagagacacgaccggtgctcgatttagtgtagtgtgaagggaaaggggacccaaaaaccacacccctccttgggagaatcccctagatcacagctcctcaccatggactggacctggagcatccttttcttggtggcagcagcaacaggctcccactcccacttttatttgatgcagtctggggctgaggtgaagaagcctggggcctcagtgaaggtctcctgcacggcctctggtaacacctttaccagtcatggtattatctgggtgcgacaggcccctggacaagggcttgagtggatgggatgggtcagccctttcaatggtgagacaaactatgcacagaaactccagggcagagtcaccatgaccacagacacatccacgaccacagcctacatggagttgaggagcctgagatctgacgacacggccggtttatttctgtgcgaggagggggggcctaccggaagtttggcgtggttatctaggttgaccgtatgggcgaggaccccgtacgaccgtctcc

SEQ ID NO: 532466 - DNA, 532 bp, Homo sapiens
  misc_feature: HEFZJCU01AK01G.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccagtcggaaccccggtccg

SEQ ID NO: 532467 - DNA, 517 bp, Homo sapiens
  misc_feature: HEFZJCU01DP280.40.81.H04.1.454.heavy.3.raw
tctagcgactcacgaccggtgctcgatttagtagtgtagattcgcgggggacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagtaactttcagggcagggtcaccatgacctgggacgcgtccatcagcacagtctacatggatctgagcggactgacctctgacgacacggaccatgtattactgtggaagagacgttggtggctaccgcgggggctggaccacgtggggaccgaggggaaccctggtccg

SEQ ID NO: 532468 - DNA, 532 bp, Homo sapiens; identical to SEQ ID NO: 445228
  misc_feature: HEFZJCU01EFWF1.7.78.H01.1.454.heavy.3.raw

SEQ ID NO: 532469 - DNA, 422 bp, Homo sapiens
  misc_feature: HEFZJCU01BUWVS.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgaccctggggccagggaatactggtcaccgtctcctcagcctccaccaagggcccatcggtcttccccctggcaccctcctccaagagcacctctgggggcacagcgccctgggctggcctggtcaaggactacttccgagtagtaca

SEQ ID NO: 532470 - DNA, 470 bp, Homo sapiens
  misc_feature: HEFZJCU01D1YAS.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtgtggcacacgctattcacagaagtttcaggcagggtcaccatgaccagggacacgtccatcagcacagcctacatggaattgagcgaggctgacatctgacgacaccggccgtgtattattgtgcgagacg

SEQ ID NO: 532471 - DNA, 499 bp, Homo sapiens
  misc_feature: HEFZJCU01DY5GT.10.34.D01.1.454.heavy.3.raw
catagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgtt

SEQ ID NO: 532472 - DNA, 515 bp, Homo sapiens
  misc_feature: HEFZJCU01B2F14.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggtgcctggggccaagggaccacggtcatcgtctccgcagcctccaccaagggcccatcggtcttccccctggccaccctcctccaagagcacctctgggggcacagcggccctcgggctgcctggtcaaggactacttccgagtgcgtct

SEQ ID NO: 532473 - DNA, 536 bp, Homo sapiens
  misc_feature: HEFZJCU01CQ6QN.17.28.C06.1.454.heavy.3.raw
  modified_base (524)..(524): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttattggggccaggganccctggtcaccg

SEQ ID NO: 532474 - DNA, 518 bp, Homo sapiens
  misc_feature: HEFZJCU01CGY62.53.35.D02.1.454.heavy.3.raw
cgcgtatacacacgaccggtgctcgatttagcacacgatagttgggtttgggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgtaacttaattacggaggacaaccggtaacccccgtccgctac

SEQ ID NO: 532475 - DNA, 514 bp, Homo sapiens
  misc_feature: HEFZJCU01CLM8V.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatggttggatcaatggtgaaactggaaaaaccaaagtattcaccgagcttccagggcagaatgaccatctcccgggacacatccgcgagcgcaatctatctgaactgagccgcctgacatctgcagactcggcagtatatttctgtgcgagaggaggggaggatgggttgagggtaattgttattccatactactttgaccagtcggggccaggggtaa

SEQ ID NO: 532476 - DNA, 529 bp, Homo sapiens
  misc_feature: HEFZJCU01D1F2C.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtctaccgtctcctcagcctccacc

SEQ ID NO: 532477 - DNA, 500 bp, Homo sapiens
  misc_feature: HEFZJCU01AI5Z0.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtgtattacgagttgggagagatgggaggtcggattattgtta

SEQ ID NO: 532478 - DNA, 347 bp, Homo sapiens
  misc_feature: HEFZJCU01CAT8B.52.1.A01.1.454.heavy.3.raw
  modified_base (280)..(280): a, c, t, g, unknown or other
cgcagtacgacacgaccggtgctcgatttagacgtctcatcagggggctttctgagagtcatggacctcctgtgcaagaacatgagcacctgtgtttttcctcctgctggtggcagcctcccagatgggtcctgtcccacgtgcagctgcaggagtcgggcccaggactggtgaagtccttcggagatcagtggtccctcacctgctctgtctctggtgacttccatccagcagttggttattactgggcctgggtccggcagcccccagggagggtttnacgtggattgggagtatcgatcgacgagtgggagcaccgtacctggaaccccgtccgtcacgactcg

SEQ ID NO: 532479 - DNA, 524 bp, Homo sapiens
  misc_feature: HEFZJCU01ENSST.18.33.C11.1.454.heavy.3.raw
tacgagtatgcacgaccggtgctcgatttagagtgagctcgttgggtttggggggggagaggagcccagcactgggattccgaggtgtttccattcggtgatcggcactgaacacagaggactcaccatggagttttggctgagctgggttttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgttatttttgtgcgagcgacccggggctcctcaatggctttcattactggggccacgggaaccct

SEQ ID NO: 532480 - DNA, 536 bp, Homo sapiens
  misc_feature: HEFZJCU01EJ4E4.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtggttggccgtattaaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactcccctgaaacgcgtcaactactactactacggtatggacctcgtggggccaa

SEQ ID NO: 532481 - DNA, 541 bp, Homo sapiens
  misc_feature: HEFZJCU01CS7AG.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttaggactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctcgaaacgcgtacaactactactactacggtataggactctgggaccgg

SEQ ID NO: 532482 - DNA, 525 bp, Homo sapiens
  misc_feature: HEFZJCU01EJVTM.40.33.C11.1.454.heavy.3.raw
tctagcgactcacgaccggtgctcgatttagagtgagctcgttgggtttgggggagccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaagtggggactaatgaatatggtgtggacgtctggggccaagggaccacggtcgtcgtcc

SEQ ID NO: 532483 - DNA, 528 bp, Homo sapiens
  misc_feature: HEFZJCU01EE1IC.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtggaggggccgattcaccatctccagagacaactctaagaacacgctgtttcttcaaatgaacagcctgagagccgatgacacggccgtgtattactgtgcgagagagtggggcccacgaacgttactacgctatggacgtcgtggggccgaagggaccac

SEQ ID NO: 532484 - DNA, 509 bp, Homo sapiens
  misc_feature: HEFZJCU01ES4F2.17.10.A10.1.454.heavy.3.raw
  modified_base (471)..(471): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctgggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtactacatgcaactgacgagcctgagagcgtgacgacacggcccgtctattacctgtgccgagaatgttttctgtacntcgtacaatttgataggtctctatggatggacttcgtc

SEQ ID NO: 532485 - DNA, 520 bp, Homo sapiens
  misc_feature: HEFZJCU01D4GLF.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 532486 - DNA, 520 bp, Homo sapiens
  misc_feature: HEFZJCU01C7XCX.12.40.D07.1.454.heavy.3.raw
atacgacgtacacgaccggtgctcgatttagtgatagagcgtaacaacagagggctcaccatggagtttgggctgagcgtgggtttcctcgttgctcttttaagaggtgtccagtgtcagggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccagggcccatcggtcttcccctggccg

SEQ ID NO: 532487 - DNA, 464 bp, Homo sapiens
  misc_feature: HEFZJCU01C5BKA.48.23.C01.1.454.heavy.3.raw
agtatacatacacgaccggtgctcgatttagtacacgtgattagggattgggtagggattggggcagggtgtacacctgtggttctcggggctgccctttggctttggagatggttttctcgatggggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgtctcttcagcctccaccaagggcccatcggtcttccccctggcaccctcctccaagagcacctctgggggcacagcggccctgggctgcctgtcaaggctacttcctatgtatact

SEQ ID NO: 532488 - DNA, 520 bp, Homo sapiens
  misc_feature: HEFZJCU01C020O.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctcctgaagctgacctttgtgactgccgcggacacggccgtgtattactgtgcgagacgacccctccgatagcagtggctggtccactaggtttgactactggggccagggaagcttggtcaccgtctcctcagcct

SEQ ID NO: 532489 - DNA, 544 bp, Homo sapiens
  misc_feature: HEFZJCU01EGSXT.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaagggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtagtattattgtataggttatggtggtaattcgggcccctggggccagggaaccgtggtcaccgtctcctcacgcctccaccg

SEQ ID NO: 532490 - DNA, 533 bp, Homo sapiens
  misc_feature: HEFZJCU01B3KHB.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaaggcccattccggtccttcccccgtggtccgcccgtcg

SEQ ID NO: 532491 - DNA, 526 bp, Homo sapiens
  misc_feature: HEFZJCU01CHHPJ.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcacccgtggttctacttcgatctctggggccgtc

SEQ ID NO: 532492 - DNA, 426 bp, Homo sapiens; identical to SEQ ID NO: 474555
  misc_feature: HEFZJCU01B8ZP3.4.37.D04.1.454.heavy.3.raw

SEQ ID NO: 532493 - DNA, 506 bp, Homo sapiens
  misc_feature: HEFZJCU01EIUH8.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgacgtgcttgtttggagcttttgactactggggccagggaaccctggtcatcgtctcctcagcctcaccaaggcccatcgtcttcccctggcaccctcctccaagagcacctcgtgggggcacagcggcccgtgggctgcctggtcaaggactacttccgagtagtaca

SEQ ID NO: 532494 - DNA, 533 bp, Homo sapiens
  misc_feature: HEFZJCU01D7EHV.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctagtctattattgtgcgagagtaagtggtcatggtccttttgaccagtggggccagggaaccctggtcaccgtctcctcagcttccaccaacgggcccatcgggttcttcccccgtggccgcccgtcgtctccgaggacgcacctcgtcgggggtccgacgacgcc

SEQ ID NO: 532495 - DNA, 519 bp, Homo sapiens
  misc_feature: HEFZJCU01DBGU7.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctccgggacagacttaccatgaccacgaactcctccataaacacagcctacatggagttggaggagcctgacatctgacgacacggccgtctattactgtgcgagagtcccacgactccgggtgagcctacggcacggcggcctttgacttcgtggggccgaggggaccg

SEQ ID NO: 532496 - DNA, 500 bp, Homo sapiens
  misc_feature: HEFZJCU01C2UYH.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctatttagaaggtgtccagtgtgaggtgcagctggtggagtctgggggaggcctggtcaagcctggggggtccctgagactctcctgcgcagcctctggattccaccttcagtagttatagcatgaactgggtccgcaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatcgtaggaaccccgag

SEQ ID NO: 532497 - DNA, 519 bp, Homo sapiens
  misc_feature: HEFZJCU01CPG6V.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccggtagacacgtccaacgaaccaattctccctgaagctgagctctgtgaccgccgcagacacggctgtctattactgtgtcgacggccccgagcgcaggtggtcgtttttcgtatgtcctttgtattagtggtggggaccgaagggacgtaagtggttcacccgtc

SEQ ID NO: 532498 - DNA, 494 bp, Homo sapiens
  misc_feature: HEFZJCU01EZFVN.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaatgaacagcctgagagctgaggacacggctgtgtattactgtgacgaaagtatttctata

SEQ ID NO: 532499 - DNA, 551 bp, Homo sapiens
  misc_feature: HEFZJCU01ECIW9.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtacaaccacgtgatgtgggtccgccagcctccagggaaggggctggaatgggtctcagttattgaaatgatggtgacacaatctacgccgactccgtgaagggccgattcaccatctccagagacaattccaagaacacggtgaatcttcaaatgaacagcctgagaaccgaggacacgggccgtatattattgttataggttatgggtggtaagttcgggccccgtggggccgaggggaccgtaggtccaccgtctcctcacgcctccaaccg

SEQ ID NO: 532500 - DNA, 527 bp, Homo sapiens
  misc_feature: HEFZJCU01B7VWN.13.57.F02.1.454.heavy.3.raw
  modified_base (447)..(447): a, c, t, g, unknown or other
tcacgtactacacgaccggtgctcgatttagctcgatatagttgggtttggggtgggaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatcgtttcatagcgggatcaccaactacaacccgtccctcaagagtcgagtcaccatatctatagacaagtccaagaaccacttctccctgaacgtgagttctgtgaccgccgcggacacggccgtgtattactgtgcgagnggattgtggttttactctggttcaatgagttattatgtctttgacttatggggccagggaaccctggtcaccgtctcctc

SEQ ID NO: 532501 - DNA, 498 bp, Homo sapiens
  misc_feature: HEFZJCU01D4YG1.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcacatctccagagacaatcgcaagaacacactgtatctaggaaatgaccagcctgagaggtgacgacacgggtgtttattactgtgcgcgggaatagaggctcatcgtggatacaact

SEQ ID NO: 532502 - DNA, 524 bp, Homo sapiens
  misc_feature: HEFZJCU01EG0BB.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgtttcacgctctatggttcggggagttattagtcccttactttgactactgggggccaggggaactctggtcaccgttctccgcagcctccaccaaggggcccagtcc

SEQ ID NO: 532503 - DNA, 534 bp, Homo sapiens
  misc_feature: HEFZJCU01EJCQW.52.71.G05.1.454.heavy.3.raw
  modified_base (464)..(464): a, c, t, g, unknown or other
cgcagtacgacacgaccggtgctcgatttagtgtcgtcgcaagagagaggggcagggggcagggtgtacacctgtggttctcggggctgccctttggctttggagatggttttctcgatgggggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagcgacgacgacggccgtatattactgtgcgaagnaattactctatggacattatggtcccattgactacgtcggggccaggggaaccctggtccaccgtcctcc

SEQ ID NO: 532504 - DNA, 521 bp, Homo sapiens
  misc_feature: HEFZJCU01BK0DH.49.25.C03.1.454.heavy.3.raw
agtcgagagacacgaccggtgctcgatttagtagtgtagatttgggtttggggagctctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggacgctggacgaggagccctacgggccgggt

SEQ ID NO: 532505 - DNA, 428 bp, Homo sapiens
  misc_feature: HEFZJCU01C81UU.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcaagcacgtccatcagcacagcctacatgga

SEQ ID NO: 532506 - DNA, 520 bp, Homo sapiens
  misc_feature: HEFZJCU01EGZQG.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgttcttcaaatgaacagcctgagagccgatgacgacggccgtgtattactgtgcgagagagtggggcccacgaacgttactacgctatggacgtcgtggggccaagggaccg

SEQ ID NO: 532507 - DNA, 523 bp, Homo sapiens
  misc_feature: HEFZJCU01DDHAM.13.63.F08.1.454.heavy.3.raw
  modified_base (495)..(495): a, c, t, g, unknown or other
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcgggactcctcttgagatctggggccnggggacaagtggtcaccgtctcttcagt

SEQ ID NO: 532508 - DNA, 544 bp, Homo sapiens
  misc_feature: HEFZJCU01BFH50.7.70.G04.1.454.heavy.3.raw
  modified_base (532)..(532): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcgacccggggaagggcctggagtggattggatacatctattactttgggagcacctactacaacccgtcctcaagagtcgagtaacgatctcagtggacacgtctaacaatcacctctccctgaggctgacgctctgtgacagccgcggacacgggcgtttattacctgtgcggagaggggacggaactcggtacgacttacgtgggggttccgaccccgtgggggccaggggaaccctgggtcctaccgtcctcctcncgccctccaccg

SEQ ID NO: 532509 - DNA, 493 bp, Homo sapiens
  misc_feature: HEFZJCU01BVKQN.4.7.A07.1.454.heavy.3.raw
  modified_base (394)..(394): a, c, t, g, unknown or other
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagngacaattccaagaacacgctgtatctgcaattgaacagcctgagagccgaggacacggccgtatattactgtgacgaaagattggggaatgaccacgtc

SEQ ID NO: 532510 - DNA, 521 bp, Homo sapiens
  misc_feature: HEFZJCU01EE3ZN.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctgggccaagggaccacggtcaccgtctcctcagcctccaccaagggcccatcggtcttcccctggcgccctgctccaggagcacctccgagagcacagcggccctggctgcctggtcaggactacttcccgtgtctgat

SEQ ID NO: 532511 - DNA, 505 bp, Homo sapiens
  misc_feature: HEFZJCU01AZSKD.12.55.E11.1.454.heavy.3.raw
  modified_base (490)..(490): a, c, t, g, unknown or other
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacttttctggtatttcgatctctggggccgtggcaccctggtcactgtctcctcggcttcaccaaggccatcgtcttcccctggcgccngctcagagcacctcg

SEQ ID NO: 532512 - DNA, 541 bp, Homo sapiens
  misc_feature: HEFZJCU01AWZB5.11.25.C03.1.454.heavy.3.raw
  modified_base (432)..(432): a, c, t, g, unknown or other
cgagagataccacgaccggtgctcgatttagtagtgtagatttgggtttgggggggaggaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaagggctggagtgggtctcctttatttacagcagtggtagtacatattccgcagactccgtggaggggccgattcgaccatcctccagagacaactctaagaacacgctgtttcttcaaatnaacacgcctgagagccgatgacacggccgtgtattactgtgcgagagagtcgggggcccacgaacgttacgtacgctagtggacgtcgtcgggggccaaggggacctac

SEQ ID NO: 532513 - DNA, 492 bp, Homo sapiens; identical to SEQ ID NO: 463747
  misc_feature: HEFZJCU01DVGSY.47.85.H08.1.454.heavy.3.raw

SEQ ID NO: 532514 - DNA, 351 bp, Homo sapiens
  misc_feature: HEFZJCU01A03AL.10.38.D05.1.454.heavy.3.raw
catagtagtgcacgaccggtgctcgatttagtatctgatagttgggtttggggggaagaggaagactgacggtcctgccacaggtggtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 532515 - DNA, 513 bp, Homo sapiens
  misc_feature: HEFZJCU01EKZVS.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttacccctggcaccctcctccaagagcacctctgggggcacagcggccctgggctgcctggtcaaggactacttccgagtgcgtct

SEQ ID NO: 532516 - DNA, 514 bp, Homo sapiens
  misc_feature: HEFZJCU01C98II.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggggtttgagtggatgggggtggatcaaccctaccagaggtggcacaaagtatcgacagaactttcagggcagggtcaccatgacctgggacgcgtccatcagcacagtctacatggatctgagcggactgacctacgtcgaccgactacgggccatgtaattactgtggaagagacgttggtggctacggcggggctcggaccacgtgggggcccg

SEQ ID NO: 532517 - DNA, 513 bp, Homo sapiens
  misc_feature: HEFZJCU01AU1AC.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctcccagggcagactcaccatgaccacagacacatcagcgaacacagtcaacatggagttgcggagcctgcgatctgacgacgcggccgtatattactgtgcgagagtacgtagcggctcgtcctttgactaatggggcctgggactctggtcaccgtct

SEQ ID NO: 532518 - DNA, 514 bp, Homo sapiens
  misc_feature: HEFZJCU01CUSZX.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgttgttttcgatcgccgttcggtccggcgggtacttcgtggggtccgaac

SEQ ID NO: 532519 - DNA, 535 bp, Homo sapiens
  misc_feature: HEFZJCU01B8W0S.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatatttaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttaatgggttggggggagttggggtttttttttcgttacgtacggggat

SEQ ID NO: 532520 - DNA, 526 bp, Homo sapiens
  misc_feature: HEFZJCU01AQCIY.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcggaggacacggccatatattactgtgcgaaagatcctgaggcctataccacctcagtcagctggttcgacccctgggccagggaaccctggtcaccgtctcctcagcctccaccaagggcccatcggtccttcccctggcaccctcctccaacgagcacctctgggggcacagcggccctcggggctgcctggtcaaaggactacttaccgagtagtactac

SEQ ID NO: 532521 - DNA, 481 bp, Homo sapiens
  misc_feature: HEFZJCU01AVKDN.40.71.G05.1.454.heavy.3.raw
  modified_base (459)..(459): a, c, t, g, unknown or other
  modified_base (474)..(474): a, c, t, g, unknown or other
tctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacactccaccagcacagcctatatggaggtgaggagcctgacatctgacgacacggccgtaatatactgtgcgagngatcatcggagtgangccgtgt

SEQ ID NO: 532522 - DNA, 522 bp, Homo sapiens
  misc_feature: HEFZJCU01CQ24D.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacaggaactttcagggcgagggtcaccatgacctggggacgcgtccatcagcacagtctacatggatctgagcggactgacctctgacgtacacggccagtgtattactggttaggaagtaggacgttagggtggcgttaccggccgggggtctggacccacgtgggggaccc

SEQ ID NO: 532523 - DNA, 520 bp, Homo sapiens
  misc_feature: HEFZJCU01BEY7B.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtcggggccacgaacgttacacgtctagtcggacgtcgtggggcc

SEQ ID NO: 532524 - DNA, 519 bp, Homo sapiens
  misc_feature: HEFZJCU01D7XUE.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtccttcccctggccaccctcctccaacgagcacctctgggggcacgagcgcctggctgcctggtcaggactacttcctagagacacg

SEQ ID NO: 532525 - DNA, 537 bp, Homo sapiens
  misc_feature: HEFZJCU01CAXRI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacaccgaacctactggccaatactatgggggtcgttgttcgtggggccgaggggaccctggtcatcgtctccccagcctccacccaagggcccatccggtcctttccccctggccgcctcg

SEQ ID NO: 532526 - DNA, 381 bp, Homo sapiens
  misc_feature: HEFZJCU01E1UNP.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgaggagtcgaggacacggccgtatattattgtgttaaatgggatgggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 532527 - DNA, 515 bp, Homo sapiens
  misc_feature: HEFZJCU01DLDOF.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctaacgcagactccgtgaagggccgcttcaccatctccagagacaattccaagaacacgctgtatctccaaatgaacagtactcagagccgaggacacggccatatattactgtgcgaaagacacagccgcatttggggggagtcatcgtcctt

SEQ ID NO: 532528 - DNA, 515 bp, Homo sapiens
  misc_feature: HEFZJCU01CM1WN.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgaacgacacggccatatattactgtgcgaaagcaaccggcagttagtcacccactactactttgactacgtcggggccg

SEQ ID NO: 532529 - DNA, 497 bp, Homo sapiens
  misc_feature: HEFZJCU01B0BDH.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaacgacacggccatttattactgtgcgagagatgcgacgggccctcccacattcggtttattttccgtttgacttccgtggggccgacgggaccctggtcaccgtc

SEQ ID NO: 532530 - DNA, 495 bp, Homo sapiens
  misc_feature: HEFZJCU01A9FCN.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaatttcgagaacacattgaatctacagatgaacagtctgagagcgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctc

SEQ ID NO: 532531 - DNA, 518 bp, Homo sapiens
  misc_feature: HEFZJCU01CJZAK.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacccttagcggttatgccatgagctgggtccgccaggctccgagggaaggggctggagtgggtctctaacttttagtggtagtggtggtcacgttttccactacgcagagtccgtgaagggccgattcaccatctccagagacacttccgagaacacgctgtatctgcgaatgaacagcctgagagtcgaggacacggccatatattactgtgacgaaagatccgtgacggccttataccacctcagtcagctggttccgacccc

SEQ ID NO: 532532 - DNA, 497 bp, Homo sapiens
  misc_feature: HEFZJCU01D8J7G.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaagggttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtggatattgtggcagctccaggtgcccagcccggccccttacc

SEQ ID NO: 532533 - DNA, 515 bp, Homo sapiens
  misc_feature: HEFZJCU01BVGHC.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcatatgaacagcctgaacgaccgaggacaacagccgtctattactgtgttagggtagttttacgtagtttttggta

SEQ ID NO: 532534 - DNA, 518 bp, Homo sapiens; identical to SEQ ID NO: 444718
  misc_feature: HEFZJCU01EEURA.9.34.D01.1.454.heavy.3.raw

SEQ ID NO: 532535 - DNA, 524 bp, Homo sapiens
  misc_feature: HEFZJCU01B8QDZ.12.11.A11.1.454.heavy.3.raw
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataacagcctagaaagccgaggacacggctgtgtattttctgtgcgaggtacgtccgtacggtgaacaaatttattacaaaccagacaaagtttcc

SEQ ID NO: 532536 - DNA, 557 bp, Homo sapiens
  misc_feature: HEFZJCU01EMF8Q.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccaggggaaggggctggagtgggtggccaacataaagcaagatgggaactgccgagttttacgtggactctgtgaagggccgtttcaccatcgtccagagacaacgccaagaattcactgtatctacaactgaacagcctgagagtcgcagacgacggccggtgtattactggtgcgtagatgtagggtaaaaataaagtggctggttgtttagttgggggccgaggggacgccccgtgggtctacg

SEQ ID NO: 532537 - DNA, 525 bp, Homo sapiens
  misc_feature: HEFZJCU01BC7FZ.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctgggccagggaaccctggtcaccgtctcctcagcctccaccaagggcccatcggtcttcccctggcacccgtcctccaagagcacctctgggggcacgagcc

SEQ ID NO: 532538 - DNA, 507 bp, Homo sapiens
  misc_feature: HEFZJCU01BA1ED.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctcggcaccctcctccaagagcacctctgggggcacagcggccctgggctgcctggtcaaggactattccgagtagtaca

SEQ ID NO: 532539 - DNA, 533 bp, Homo sapiens
  misc_feature: HEFZJCU01CLG3J.48.57.F02.1.454.heavy.3.raw
agtatacatacacgaccggtgctcgatttagctcgatatagttgggtttgggggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatgggggatggtgacaagcgttacagtgcatctctgaagaccagactctccatcaccaaggacacctccaagaacgaggttgtcctttcttggccaacatgcaccctgtggacacggccacttatttttgtactacacaccatcttgacgactggggatgtcttttctatttctgggggccgagggggaccgtgggtcgccggtgtctactagccttccaccaagggcccatccggttcttccccc

SEQ ID NO: 532540 - DNA, 482 bp, Homo sapiens
  misc_feature: HEFZJCU01DIM5L.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaagactacttccgtatctctcg

SEQ ID NO: 532541 - DNA, 495 bp, Homo sapiens
  misc_feature: HEFZJCU01EUH6D.22.78.H01.1.454.heavy.3.raw
acatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttcccctgcaccctcctccaagagcacctctgggggcacagcggccctgggctgcctggtcaaggactacttccagacgtatca

SEQ ID NO: 532542 - DNA, 506 bp, Homo sapiens
  misc_feature: HEFZJCU01BK4E8.40.81.H04.1.454.heavy.3.raw
  modified_base (466)..(466): a, c, t, g, unknown or other
  modified_base (484)..(484): a, c, t, g, unknown or other
  modified_base (496)..(496): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactggacctctgacgacgacggccatgtatttaactgtggaagngacgttggtggctaccgnggggctgaaccncgtggggccg

SEQ ID NO: 532543 - DNA, 512 bp, Homo sapiens; identical to SEQ ID NO: 494490
  misc_feature: HEFZJCU01CZ7SE.12.25.C03.1.454.heavy.3.raw

SEQ ID NO: 532544 - DNA, 492 bp, Homo sapiens
  misc_feature: HEFZJCU01C23RN.51.38.D05.1.454.heavy.3.raw
  modified_base (447)..(447): a, c, t, g, unknown or other
cgatcgtatacacgaccggtgctcgatttagtatctgatagttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggaccgattcaccatctccagagacagttccgatgacacagtctatctacacatgagcagtatganacctgacgacacggcttcgtttttactgttgcgtcccaggtaacg

SEQ ID NO: 532545 - DNA, 514 bp, Homo sapiens
  misc_feature: HEFZJCU01C7CFC.2.16.B05.1.454.heavy.3.raw
  modified_base (464)..(464): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagactatgtggactctgtgaagggccgattcaccatctccagagacaacgccaagaactcactgtatctgcaaatgaacagcctaagacccgaggacacggctgtntattactgtgcgagagaccgctactcgggggcccgggagccctggtaccg

SEQ ID NO: 532546 - DNA, 517 bp, Homo sapiens
  misc_feature: HEFZJCU01B4HR4.40.9.A09.1.454.heavy.3.raw
tctagcgactcacgaccggtgctcgatttagcgagacgcgcaggggggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttggggtccgtcaggctccagggaaagggctggagtttgtggccaagatgaaccacgacggaaatgagaaaactatgcggactctgtgaagggccgattcaccatttccagagacaacgccaagaagtcactctctctacacatgaccagcctgacagccgaggacacggctgtttattactgtgcgagagatggcacgtcgggggcggtggtactttgactacgtcggggg

SEQ ID NO: 532547 - DNA, 394 bp, Homo sapiens; identical to SEQ ID NO: 446347
  misc_feature: HEFZJCU01D439G.52.41.D08.1.454.heavy.3.raw

SEQ ID NO: 532548 - DNA, 530 bp, Homo sapiens
  misc_feature: HEFZJCU01D8VMC.40.33.C11.1.454.heavy.3.raw
tctagcgactcacgaccggtgctcgatttagagtgagctcgttgggtttgggggagccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacgacgggtgtctattattagtacaaaaggtggggactaagtgaatatggtggtggacgtcgtgggccgaagggaccacggtcgtcgt

SEQ ID NO: 532549 - DNA, 538 bp, Homo sapiens
  misc_feature: HEFZJCU01D4FGC.48.44.D11.1.454.heavy.3.raw
agtatacatacacgaccggtgctcgatttagcgcagtacgaagggggggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaatggacacctgaaaaccgaggacacggccgttttattatttgtacttctgaggtgacgggaaccgctggctattggggcagggaaccct

SEQ ID NO: 532550 - DNA, 508 bp, Homo sapiens
  misc_feature: HEFZJCU01DODJG.11.57.F02.1.454.heavy.3.raw
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcggaaggacacgg

SEQ ID NO: 532551 - DNA, 513 bp, Homo sapiens
  misc_feature: HEFZJCU01A4YB3.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaagggctggagtgggtcgcatccattagtggtggtaataattacatatactacggagactcaatgaagggccgcttcaccatctccagagacacgccgaaaactcactgtatctgcagatgaacagcccgtgagagccgaagacacggctgtgtattactgtgcgagaggtcttactatagttcgggagttaatataacgacgtattcgta

SEQ ID NO: 532552 - DNA, 386 bp, Homo sapiens
  misc_feature: HEFZJCU01A2CYW.11.27.C05.1.454.heavy.3.raw
cgagagataccacgaccggtgctcgatttagacgcgatcgaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgttgcgagaggagctattatctggaaccccgatgcttttgatttctggggccaagggacaatgctcaccgtctcttcagcctccaccaagggcccatcggtcttccccctggcaccctcctccaagagcacctctgggggcacagcggccctggctgcctggtcaaggctacttccgtatctctcg

SEQ ID NO: 532553 - DNA, 531 bp, Homo sapiens
  misc_feature: HEFZJCU01DDN85.12.14.B03.1.454.heavy.3.raw
  modified_base (472)..(472): a, c, t, g, unknown or other
atacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcattttccttttggctattttaaagggtgtccagtgtgaagtgcacttggaacagtcggggggagcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctggggacacggccctgtatttcngttcaaaggggctcgtgttcagggatggggctttgacctcctgggcccaggggaaccct

SEQ ID NO: 532554 - DNA, 506 bp, Homo sapiens
  misc_feature: HEFZJCU01AN3JN.10.38.D05.1.454.heavy.3.raw
  modified_base (493)..(493): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcnggggccagggacg

SEQ ID NO: 532555 - DNA, 542 bp, Homo sapiens
  misc_feature: HEFZJCU01EWM6W.17.28.C06.1.454.heavy.3.raw
  modified_base (483)..(483): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagntgtggaaaaagtaagtgctgttgtttagttggggccgaggggagcccctggtctacccg

SEQ ID NO: 532556 - DNA, 516 bp, Homo sapiens
  misc_feature: HEFZJCU01A1QX0.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccgaaac

SEQ ID NO: 532557 - DNA, 481 bp, Homo sapiens
  misc_feature: HEFZJCU01BM3VG.49.27.C05.1.454.heavy.3.raw
agtcgagagacacgaccggtgctcgatttagacgcgatcgaagggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgcaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgagacacggctgtgtattactgtgcgtaaa

SEQ ID NO: 532558 - DNA, 540 bp, Homo sapiens
  misc_feature: HEFZJCU01A2XYS.8.25.C03.1.454.heavy.3.raw
ctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactctgggggaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattcaaaagcatcgcctttctacaaatggacagcctgaaaaccgaggacacaggcgtgtattactgcaacaggtttggttcgggaaatccgacaaatgacctctgggccagggaaccctggtcaccgtctcctcacgcctaccc

SEQ ID NO: 532559 - DNA, 527 bp, Homo sapiens
  misc_feature: HEFZJCU01CN3JD.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctggacggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttaatctgcaaatagacagcctgagaccagacgacacggctgtctattattgcgcgagagagacacacgaacctactggccaatactatagggggcttgttctggggccgaggggaccctggtcagtcgtctccccagcctccaccaagggcccatcggtcttccccctcggcg

SEQ ID NO: 532560 - DNA, 519 bp, Homo sapiens
  misc_feature: HEFZJCU01CSEXV.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactctggggccagggaaccctggtcatcgtctcctcagcctccaccaagggcccatcggtcttcccctggccgcctgctccaggagcaccctccgacgacggcaccacgccggcccgtcggggctcggccctcgggtcaaacgggacgtacctttacccgtaccgtacagcctctgac

SEQ ID NO: 532561 - DNA, 539 bp, Homo sapiens
  misc_feature: HEFZJCU01EJPJH.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttaatctgcaaatagacagcctgagaccagacgacacggctgtctattattgcgcgagagagacacacgaacctactggccaatactagtgggggcttgttctggggccaggggaccctggtcatcgtctccccagcctccaccaacgggcccagtccggtccttcccccgtcggccgtcccgtcg

SEQ ID NO: 532562 - DNA, 504 bp, Homo sapiens
  misc_feature: HEFZJCU01CDBSY.48.60.F05.1.454.heavy.3.raw
  modified_base (473)..(473): a, c, t, g, unknown or other
agtatacatacacgaccggtgctcgatttagtacgtcatcagggaaaggggtctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccagcactcactgtatctaccaatgaacagcctgagagccgacgacacggctgtgtattactgtgngagacttgggagagagtggggacctacttcg

SEQ ID NO: 532563 - DNA, 491 bp, Homo sapiens
  misc_feature: HEFZJCU01BFB3T.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatcgaccgagggacacgtccatcagcacagcctacatggagctacacggcctgagatctgacgacacggccctgttatttttgtgtcggagagagtctaattaaaggtgg

SEQ ID NO: 532564 - DNA, 494 bp, Homo sapiens
  misc_feature: HEFZJCU01AZOF7.51.27.C05.1.454.heavy.3.raw
cgatcgtatacacgaccggtgctcgatttagacgcgatcgaagggtttgggggggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaaggccgattcaccatctccagagacagttccgatgacacagtctatctgcaaatagaacagcctgagagctgaggacacggctctttttactgtgcgccaggaagcagtggctggccac

SEQ ID NO: 532565 - DNA, 525 bp, Homo sapiens
  misc_feature: HEFZJCU01BLJAZ.7.78.H01.1.454.heavy.3.raw
  modified_base (515)..(515): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttattttgtacgagagcgtcgtctgtcagtgattgactacgtgggccagggaaccctggtcaccgtctcctnagcctccacc

SEQ ID NO: 532566 - DNA, 520 bp, Homo sapiens
  misc_feature: HEFZJCU01DTWOF.51.71.G05.1.454.heavy.3.raw
cgatcgtatacacgaccggtgctcgatttagtgtcgtcgcaagagagaggggctcttttaagaggcgtccagtgtcaggtgcagctggtggagtctgggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatcgtggggccgaagggacaatggtcattgtctcttcagcctccaccaagggccccagtccggttccttcccccgtcggcctacccctccctaccaacgacg

SEQ ID NO: 532567 - DNA, 353 bp, Homo sapiens
  misc_feature: HEFZJCU01BYY4F.22.86.H09.1.454.heavy.3.raw
  modified_base (341)..(341): a, c, t, g, unknown or other
acatacgcgtcacgaccggtgctcgatttagtgctatagacttgggtttgggctgagctgggttttcctcgttgctcttttaaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccggtgaagggccgattcaccatctccagagacaactccaagaacactctgtttcnccaaatgaacag

SEQ ID NO: 532568 - DNA, 496 bp, Homo sapiens
  misc_feature: HEFZJCU01C9RJX.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggccaccctcctccaagagcacctctcgggggcgacagcggccctgggctgcctggtcaaggactacttccgagtgcgtct

SEQ ID NO: 532569 - DNA, 512 bp, Homo sapiens
  misc_feature: HEFZJCU01AYJL3.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaaggcccatcggtcttcccctggcgccctgctccaggacgcacctccgagacgcacagcggccctgggctgcctggtccaaggacctacttccagtacgtatca

SEQ ID NO: 532570 - DNA, 520 bp, Homo sapiens
  misc_feature: HEFZJCU01A54OX.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagttccgaagtactcctttgacgtcgtggggcctac

SEQ ID NO: 532571 - DNA, 504 bp, Homo sapiens
  misc_feature: HEFZJCU01DZXY3.53.81.H04.1.454.heavy.3.raw
cgcgtatacacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctgggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaacgggccgattcaccatctccagagacgattccaggaacactctgtttctccaaatgaacagcctgagagctggaaggacacggctctttattactgtgcgagagattcaggatacacgccattta

SEQ ID NO: 532572 - DNA, 525 bp, Homo sapiens
  misc_feature: HEFZJCU01D9ELZ.53.64.F09.1.454.heavy.3.raw
cgcgtatacacacgaccggtgctcgatttagcgcgtatacaaggggctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagatctatgacatgagttgggtccgccaggctccggggaaggggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagaagacggaccgctggacgaggagccagaaggaaatcactactttgactacgtc

SEQ ID NO: 532573 - DNA, 539 bp, Homo sapiens
  misc_feature: HEFZJCU01EW5HU.3.17.B06.1.454.heavy.3.raw
  modified_base (431)..(431): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaataccgccgcgtctgtgaaaggcagattcaccatctcaagagatgattcagagaactcaactttanctgcaaatgaacagcctgagaacccgacgacacggccgtctattattggtgttacataggaaccttagggactaacgaaccggtacggtgggtaaccttgggtattcc

SEQ ID NO: 532574 - DNA, 507 bp, Homo sapiens
  misc_feature: HEFZJCU01CVNM5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggacaacgacctgagtggatgggatgggcgaaccctaacactggtgtcacagtgtcttcacccatcctccgggacagacttaccatgaccacgaactcctccataaacacagcctacatgggagttgaggagcctgacatctgacgacacggccgtctattactgtggcgagagtcccacgatcggtgagcctacggcagccggcctttgactttctc

SEQ ID NO: 532575 - DNA, 516 bp, Homo sapiens
  misc_feature: HEFZJCU01B3ONI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggcaggggacctggtcatcgtctcccagcctccaccaaggcccatcggtctcccctggcg

SEQ ID NO: 532576 - DNA, 485 bp, Homo sapiens
  misc_feature: HEFZJCU01AUKZ5.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacg

SEQ ID NO: 532577 - DNA, 514 bp, Homo sapiens
  misc_feature: HEFZJCU01C4NTY.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaagggctggagtgggtctcatccattagtagtaatagtgcctacagatactacgcagactcactgaagggccgaactcaccatctccagagacaacgccaagaactcactgtactctgcaaatgaaacagcctgagagccggaggaccacggctgtgtattactggtgcgaggaggagtctattactcgtcggaaaccccgatgtt

SEQ ID NO: 532578 - DNA, 556 bp, Homo sapiens
  misc_feature: HEFZJCU01BSDX7.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgttaattacttgtgtcgagatgttaggaaaaagttatgggtcttggttgttttagttcgggggccagggggacgccccgtgggtccacccggtt

SEQ ID NO: 532579 - DNA, 524 bp, Homo sapiens
  misc_feature: HEFZJCU01BGN8T.13.76.G10.1.454.heavy.3.raw
  modified_base (358)..(358): a, c, t, g, unknown or other
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcgagcctctgggttcaccgtcagtcacacctacatgagctgggtccgccaggctccagggaaggggctggagtgcgtctcttttatttatagtagtggtagtacatactccgnagactccgtgaggggccgattcaccatctccagagacaattccaagaacacgctgtttcttcaaatgaaacagcctgagagccgaatgacacggccgtgtattactgtgcgagagagtggggcccacgaacgtttactaccgactatggaccgtcgtgggggaccg

SEQ ID NO: 532580 - DNA, 503 bp, Homo sapiens
  misc_feature: HEFZJCU01C5EJ1.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaagggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgttctggggccg

SEQ ID NO: 532581 - DNA, 538 bp, Homo sapiens
  misc_feature: HEFZJCU01C57QB.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacgagttagtgggttggggggaggttggggttttttttttcgttacgttacgggt

SEQ ID NO: 532582 - DNA, 375 bp, Homo sapiens
  misc_feature: HEFZJCU01EB50Y.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttccccctggccgccctgctccaggagcacctccgagagcacagcggccctgggctgcctggtcaaggactacttcctagagacacg

SEQ ID NO: 532583 - DNA, 520 bp, Homo sapiens
  misc_feature: HEFZJCU01AQDPZ.12.40.D07.1.454.heavy.3.raw
atacgacgtacacgaccggtgctcgatttagtgatagagcgtaacaacagagggctcaccatggagtttgggctgagcgtgggttttctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggaccctggtcatcgtcctccccagcctccaccaaggtccatcggtcttcccctggcg

SEQ ID NO: 532584 - DNA, 508 bp, Homo sapiens
  misc_feature: HEFZJCU01EYIJJ.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactggtgggaccgacttttatttcaggtcgtc

SEQ ID NO: 532585 - DNA, 519 bp, Homo sapiens
  misc_feature: HEFZJCU01CS6TE.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcggggcccacgaacgttactacgctagtggacgtcgtggggaccg

SEQ ID NO: 532586 - DNA, 512 bp, Homo sapiens
  misc_feature: HEFZJCU01D291C.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacagtgactacgctacaattcgtcgggggccaggggaccg

SEQ ID NO: 532587 - DNA, 520 bp, Homo sapiens
  misc_feature: HEFZJCU01BZ5MZ.48.57.F02.1.454.heavy.3.raw
  modified_base (430)..(430): a, c, t, g, unknown or other
agtatacatacacgaccggtgctcgatttagctcgatatagttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccgggcttcaaaggacggtttgacttctccttggccacctctgtcagcacggcatatctgcagatcagcagcctaaagcctagnggacactgccgtgttttattgtgcgagatccaaggcgaggaggataccggattcgttatatagcgatactactacttcggaatggtaccg

SEQ ID NO: 532588 - DNA, 507 bp, Homo sapiens
  misc_feature: HEFZJCU01D06ZD.14.23.C01.1.454.heavy.3.raw
  modified_base (501)..(501): a, c, t, g, unknown or other
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgttggtacaactaactacacacagaagttccagggcagagtcacgattaccgcggacgaatccacgagcacagcctacatggagctgagcagcctgagatctgacgacacggccgtgtattactgtgcgagggccttcggttcgtctagtcgctcggttgtagaacgtcggggcgacgggaacgtcgtggtcgaccgtcctcctacncggtcc

SEQ ID NO: 532589 - DNA, 529 bp, Homo sapiens
  misc_feature: HEFZJCU01EBMQL.13.78.H01.1.454.heavy.3.raw
tcacgtactacacgaccggtgctcgatttagtgtgagtagtttgggtttggggtgaagaagcctgggtcctcggtgaaggtctcctgcaagccttctggaggcaccttcaacaactatgctataaactgggtgcgacaggcccctggacaagggcctgagtggatgggaggtttcatccctgtcttttgatacaacaaactacggacagaggttccagggcagactcacgattaccgcggacagatccacgagcacagtgtacatggagctgagccgcctgacatctgaagacacggccgtgtattactgtgcgagagatcggggactataccggggcgatattcgcgacctggacttctacttctacatggacgtctggggcaaagggaccacggtcaccgtctcctcagcctccaccaagggcccatcggtcttcccctggcgccctgctccaggacgcacctcccgagaggcacaacgcggcccgtgggcgtgcctggtcaaggactactttcctacgttacgtga

SEQ ID NO: 532590 - DNA, 528 bp, Homo sapiens
  misc_feature: HEFZJCU01BAQQS.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccaggaaggggctggagtgggtctcctttatttacagcagtggtagtacatattccgcagactccgtgaggggccgattcaccatctccagacgacaactctaagaacacgctgtttcttcaaatgaacagcctgagagccgatgacacggccgtgtattactgtgcgagagagtggggcccacggtaacgttactacgtctatggacgtcgtggggccaacggg

SEQ ID NO: 532591 - DNA, 509 bp, Homo sapiens
  misc_feature: HEFZJCU01DCX22.51.81.H04.1.454.heavy.3.raw
  modified_base (508)..(508): a, c, t, g, unknown or other
cgatcgtatacacgaccggtgctcgatttagtagtgtagattcgcgggggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggggcgtggtccaggctgggaggtccctgagactctcctgtgcagcctctggattcaccttcagtacccatgaaatgcactgggtccgccaggctccaggcaaggggctggagtggggtggcagttatatcctatgatggaagcaataagcactacgcagagtccgtgaagggccgtattgaccatctccagagacaactcgaagaatacggttcttctacaaatagaacagcctgagagctgaggacacggctatgttttactgtgcgagagggaactcgattacagcagccctcgaagaana

SEQ ID NO: 532592 - DNA, 490 bp, Homo sapiens; identical to SEQ ID NO: 455463
  misc_feature: HEFZJCU01C909P.11.26.C04.1.454.heavy.3.raw

SEQ ID NO: 532593 - DNA, 506 bp, Homo sapiens
  misc_feature: HEFZJCU01AZ0TH.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtctttcacccatcctccggggacagacttaccatgaccacgaactcctccataaacacagcctacatgtagttgaggagcctgacatctgacgacacggccgtctattactgtgcgagacgtcccacgatccggtgagcctacggcagcggcctttgacttctc

SEQ ID NO: 532594 - DNA, 510 bp, Homo sapiens
  misc_feature: HEFZJCU01EWLO1.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagaccttaccatgaccacgaactcctccataaacacagcctacatggagttgaggagcctgacatctgacgacacggccgtctattactgtgcgagagtcccacgatccggtgagcctacggcagcggcctttgacttctggggccagggtacg

SEQ ID NO: 532595 - DNA, 577 bp, Homo sapiens
  misc_feature: HEFZJCU01DR43J.49.60.F05.1.454.heavy.3.raw
  modified_base (354)..(354): a, c, t, g, unknown or other
agtcgagagacacgaccggtgctcgatttagtacgtcatcagggaaaggggcccctagatcacagctcctcaccatggactggacctggagcatccttttcttggtggcagcagcaacaggctcccactcccacttttatttgatgcagtctggggctgaggtgaagaagcctggggcctcagtgaaggtctcctgcacggcctctggtaacacctttaccagtcatggtattatctgggtgcgacaggcccctggacaagggcttgagtggatgggatgggtcagccctttcaatggtgagacaaactatgcacagaaactccagggcagagtcaccatggaccacagaccanatccacgaccacagcctaccatggagttgaggagcctgagatctgacgacacggccgtttatttctgtgcgaggagggggggccgtaccgtaagtttggtcgttggtttatcgttagggtttggtaccgtacgtgggggtccgacgggggtaaccccccggtacccgacccggtcccgttcccttccgacgtcccgtcccaccccgtaacggggacccctacg

SEQ ID NO: 532596 - DNA, 479 bp, Homo sapiens
  misc_feature: HEFZJCU01DR769.10.38.D05.1.454.heavy.3.raw
  modified_base (477)..(477): a, c, t, g, unknown or other
catagtagtgcacgaccggtgctcgatttagtatctgatagttgggtttggggggaagaggaagactgagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggccgccctgctccaggagcacctccgagagcacaagcggcctgggctgcctggtcaaggactacttcccacctactancg

SEQ ID NO: 532597 - DNA, 408 bp, Homo sapiens
  misc_feature: HEFZJCU01AXCME.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggcctgggctgcctggtcaaggactacttccgagtgcgtct

SEQ ID NO: 532598 - DNA, 536 bp, Homo sapiens
  misc_feature: HEFZJCU01BC0YF.16.27.C05.1.454.heavy.3.raw
tgtactactccacgaccggtgctcgatttagacgcgatcgaagggtttgggggggagaggagcccagcattagaagtcggcggtgttttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctcccagagacaattccaagaacagggtgtttctccaagtgattgatctgagaagtgaggcacggctgtttattactgtgcgcgggtgctgaccgctcttgactactcgggggccggggagccccgggtcacgtccgtcttccc

SEQ ID NO: 532599 - DNA, 508 bp, Homo sapiens
  misc_feature: HEFZJCU01EI9G2.10.12.B01.1.454.heavy.3.raw
  modified_base (492)..(492): a, c, t, g, unknown or other
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaaccaaaacataactacgcggagttcgtgaggggccgctgcatcgtctccagagacaatcgaagaacactctgtacctgcaaatgaacagtctgagagcgaggacacggccgtctacttttgtgcgactagaagtgggagntagtagggtatttacg

SEQ ID NO: 532600 - DNA, 540 bp, Homo sapiens
  misc_feature: HEFZJCU01ELXDR.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttacaacctgacgacactgccgtttatttttgttacgtagagcgtcgtctgtctagtggaattgactactggggccagggaaccctggtcaccgtctcctcagcctccaccaagggccc

SEQ ID NO: 532601 - DNA, 507 bp, Homo sapiens
  misc_feature: HEFZJCU01D5ESO.53.19.B08.1.454.heavy.3.raw
cgcgtatacacacgaccggtgctcgatttagtgagtcagtaaggggtctgggagacgagcccagcactggaagtcgccggtgtttccattcggtgatcatcaactgaacacagaggactcaccatggagtttgggctgacctgggttttcttcgttgctcttttaagaggtgtccagtgtcaggtgcagctggtggagtcggggggaggcgtggtccagcctgggaagtccctgagactctcctgtgcggcctctggattcagtttcagttggtacggcatgcactgggtccgtccaggctccaggcaaggggctggagtgggtggcaattatatcgtatgatggaaccaaaagaaactacgcagactccgtgaagggccgcttcagtatctccagagacgatcgccgggacacccctttatttgcaatgagcagcctgagagttggagacacggctgtatattactgtgcgagagaacaacctgaatatagcacgtggctggtcga

SEQ ID NO: 532602 - DNA, 507 bp, Homo sapiens
  misc_feature: HEFZJCU01DQ6DP.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccggttaaggccgcttcaccatctccagagacaattccaagaacacgctatatctgcagatgaacagcctggggaacgcccggaggaacaccggtccgtttagtccactgtgcgaaagattattgtaatga

SEQ ID NO: 532603 - DNA, 512 bp, Homo sapiens
  misc_feature: HEFZJCU01B2G03.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaccgggatactactccacctcggcttggacatctggggccgac

SEQ ID NO: 532604 - DNA, 541 bp, Homo sapiens
  misc_feature: HEFZJCU01D83W9.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggcgtgtattacgtgtgcgagattgtaggaaaaagtataggctgtgtttattgggggccaggggagccctggtcctaccg

SEQ ID NO: 532605 - DNA, 510 bp, Homo sapiens
  misc_feature: HEFZJCU01BJWI6.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctctttggatgaattgggtccgccagactccagggaagggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggacctttcggctttcg

SEQ ID NO: 532606 - DNA, 513 bp, Homo sapiens
  misc_feature: HEFZJCU01EV0EQ.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacgggctgtgtattactgtgcgagagaccgctactgggggcccgggagccctggtcc

SEQ ID NO: 532607 - DNA, 527 bp, Homo sapiens
  misc_feature: HEFZJCU01AYT9I.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacacgtctttacaacccatccctcaagagtcgagtttccatatccgcagacacgtccgagaatcacttctccctgaaactgagctctgtgaccgccgcagacacggctgtttattacttgttcgagacatgccgaccgagagcatttatcggcagttacggttttgattatttggggccaaggggacaaggggtcaccgtctccgcagcctccaccg

SEQ ID NO: 532608 - DNA, 521 bp, Homo sapiens
  misc_feature: HEFZJCU01CY3SD.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtaccttacaatgaccaatatggaccctgtggacacagcccacatattactgttcacgctctatggttcggggagttattagtccctactttgactactggggccagggactctggtcaccggtctccgcagcctcctaccaacgggcccatcc

SEQ ID NO: 532609 - DNA, 518 bp, Homo sapiens; identical to SEQ ID NO: 449255
  misc_feature: HEFZJCU01EV5BT.3.17.B06.1.454.heavy.3.raw

SEQ ID NO: 532610 - DNA, 519 bp, Homo sapiens
  misc_feature: HEFZJCU01AVYLO.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtgactctgtgaagggccgagttcaccatctccagagacaacgccaagaactcactgtatctgcaatgaacagcctaagacccgaggacacggctgtagtattactgtgtcgagaggaccgactacgtcggggcccgggagccccgtggtccg

SEQ ID NO: 532611 - DNA, 495 bp, Homo sapiens
  misc_feature: HEFZJCU01C2YH3.10.7.A07.1.454.heavy.3.raw
catagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtctgggggaggcgtggtccagcctgggaggtccctgagactctcctgtgcagcctctggattcatcttcagttgctgtggcgttcactgggtccgccaggctccaggcaaggggctggactgggtggcagtaatatcagatgatggaagtactgtatactacgcagactcagtgaagggccgattcactatctccagagacaattccaagaacacagtgtctctccaatgaacagcctgcgacctggaggacgcgggtgtctattactgtgacgaagagggtattgggaatcgtt

SEQ ID NO: 532612 - DNA, 512 bp, Homo sapiens
  misc_feature: HEFZJCU01B9Y3A.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggcctctattactgtgcgagagtcccacgatccgggtgagcccgtacggccagccggtccttttgacctttcgtc

SEQ ID NO: 532613 - DNA, 513 bp, Homo sapiens
  misc_feature: HEFZJCU01A21MM.40.68.G02.1.454.heavy.3.raw
tctagcgactcacgaccggtgctcgatttagtcgatagtgaagggaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccgatatccgtagacacgtccaagaaccaattctccctgaagctgagctctgtgaccgccgcagacacggctgtctattactgtgcgaggccccgagcgcagtggctttttgatgtctttgatatggtggggtccgaagggacaagtaggtctacccgg

SEQ ID NO: 532614 - DNA, 493 bp, Homo sapiens
  misc_feature: HEFZJCU01EBWL4.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccagagcacctctgggggcacagcggccctggctgcctggtcaggactacttccgagtagtaca

SEQ ID NO: 532615 - DNA, 521 bp, Homo sapiens
  misc_feature: HEFZJCU01DQ2QI.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttagttagtcccttactttgactactgggggccagggaactcgtaggtcacgtcctccgcagcctccaccagggcccagtcc

SEQ ID NO: 532616 - DNA, 504 bp, Homo sapiens
  misc_feature: HEFZJCU01CLH6K.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaaggccgattcaccatctccagagacaacgccaagaactcactgtatctgcaaatgaacagcctgagagccgaggacacggctgtgtattactgtgcgtagtttgtttgggtcgggatagcagcgggtaccc

SEQ ID NO: 532617 - DNA, 509 bp, Homo sapiens
  misc_feature: HEFZJCU01CBHRF.48.86.H09.1.454.heavy.3.raw
agtatacatacacgaccggtgctcgatttagtgctatagacttgggtttggggagctctcagagaggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctgggggagccttggtgcagcctggagagtccctaagactctcctgcgcagcctcaggattcagtttcagtagttatgaaatgaattgggtccgccaggctccagggaagggactgggagtggcttttcatatattactggcagtgggtctcttacccattatgcagactctgtgaggggccgattcaccatctccagagacaacccccgaaactctctttttctgtcaaatggacagccttgacagccgacgatacggccatttattactgttgcgagagatcggggacccccgcatact

SEQ ID NO: 532618 - DNA, 504 bp, Homo sapiens
  misc_feature: HEFZJCU01AOYYD.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtccacgatccggtgacgcctacggcagcggcctttgacttctc

SEQ ID NO: 532619 - DNA, 508 bp, Homo sapiens
  misc_feature: HEFZJCU01EXN13.19.59.F04.1.454.heavy.3.raw
  modified_base (496)..(496): a, c, t, g, unknown or other
tactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttagtgaaatgaattgggtccgccaggctccagggaaggggctggagtgggtttcatacattagtagtagtggtagtagcatatactacgcagactctgtgaagggccgattcaccatctccagagacagcgccaaagaactcactgtatctgcaaatgaacagcctgagagccgaggacacggctagtttattactgtgcgagagagtggcaaggtcgaggggtccganattgtagtggtt

SEQ ID NO: 532620 - DNA, 533 bp, Homo sapiens
  misc_feature: HEFZJCU01AWO7B.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggggcctctggacaaggccttgagtggatgggaaggatcgtccctatcgttgacacaccaaactacgcacagaagttccagggcagactcaccataaccgcggacaaattaacgaacacagtaatctggagctgaacagcctgtcatctgaggacacgggcttctacttctgtgcgaggagtaattactataacactgcttcctttttacaccttcccttgacttcgtggggccatggaaccccggtccg

SEQ ID NO: 532621 - DNA, 513 bp, Homo sapiens
  misc_feature: HEFZJCU01EU0R9.3.34.D01.1.454.heavy.3.raw
  modified_base (179)..(179): a, c, t, g, unknown or other
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtntaaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggacgggctactacgagaacggattgggcgcctggggccaagggaccacggtcatcgtctccgcagcctccaccaagggcccatcggtcttccccctggcaccctcctccaagagcacctctgggggcacagcggccctgggctgctggtcaaggactacttccgagtgcgtct

SEQ ID NO: 532622 - DNA, 511 bp, Homo sapiens
  misc_feature: HEFZJCU01D127E.53.10.A10.1.454.heavy.3.raw
cgcgtatacacacgaccggtgctcgatttagcgtcgatctcaggggtctgagagaggagccttagtcctggaatccaaggcctctccacttggtgatcagcactgagcaccgaggattcaccatggaactggggctccgctgggttttccttgttgctatttttagaaggtgtccactgtgaggaacaactggtggagtctgggggaggcctggtcaagcctggggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctattttctgcgcgaggaaaagtcgcattccagagcctgtacgcccgtccttc

SEQ ID NO: 532623 - DNA, 497 bp, Homo sapiens
  misc_feature: HEFZJCU01EM2AX.11.27.C05.1.454.heavy.3.raw
  modified_base (454)..(454): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctcagggaaggggctggagtgggtctcatccattagtagtaatagtgcctacagatactacgcagactcactgaagggccgactcaccatctccagagacaacgccaagaactcactgtatctgcaatgaacagcctgagagcgaggacacggntgtgtattactgtgcgagaggagcttattatctcggaaccccg

SEQ ID NO: 532624 - DNA, 490 bp, Homo sapiens; identical to SEQ ID NO: 456464
  misc_feature: HEFZJCU01DU22B.47.85.H08.1.454.heavy.3.raw

SEQ ID NO: 532625 - DNA, 527 bp, Homo sapiens
  misc_feature: HEFZJCU01DXJO6.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctgagctgaacagcctgtcatctgaggacacgggcttctacttctgtgcgaggagtaattactataacactgctccttttacacctccttgacttctgggccagtggaaccccggtcaccgt

SEQ ID NO: 532626 - DNA, 542 bp, Homo sapiens
  misc_feature: HEFZJCU01BOR60.12.40.D07.1.454.heavy.3.raw
  modified_base (408)..(408): a, c, t, g, unknown or other
  modified_base (454)..(454): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgccgngagagagacacacgaactactggccaatactatgggggcttgttcnggggccgaggggacccctgggtcatccgtctccccacgcctccaccaacggggcccagtccgggtcctttcccccgtggccgccctcg

SEQ ID NO: 532627 - DNA, 503 bp, Homo sapiens
  misc_feature: HEFZJCU01AGZX8.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactactatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctagaaatttgaggacacggcctatttattactgtgcaaggaacagcataatgactaccgtccccggactttacg

SEQ ID NO: 532628 - DNA, 429 bp, Homo sapiens; identical to SEQ ID NO: 479463
  misc_feature: HEFZJCU01D9YV1.4.37.D04.1.454.heavy.3.raw

SEQ ID NO: 532629 - DNA, 523 bp, Homo sapiens
  misc_feature: HEFZJCU01ES1CM.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtgaggggccgcttcatcatcctccagagacgatccgaaaacacagtgaatctgcaatagtacagcctcagcgccgaggacacggccgtctactctgtgcgaaagacctacttagttttcgggaccggcggccgactactcggggtaccgac

SEQ ID NO: 532630 - DNA, 348 bp, Homo sapiens
  misc_feature: HEFZJCU01CDRQH.52.78.H01.1.454.heavy.3.raw
cgcagtacgacacgaccggtgctcgatttagtgtgagtagtttgggtttgggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagca

SEQ ID NO: 532631 - DNA, 526 bp, Homo sapiens
  misc_feature: HEFZJCU01DIRCZ.12.33.C11.1.454.heavy.3.raw
  modified_base (512)..(512): a, c, t, g, unknown or other
atacgacgtacacgaccggtgctcgatttagagtgagctcgttgggtttggggggaagagggaagactgacggtcccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatattctgtgcgagagccctcggcagaagtctggactactactattatggtatggacgtctggggccaagggaccacggtcatcgtctcctcagcctccaccaagggcccatcggtcttcccctcggcaccctcctccaagagcacctntgggggcacgagcc

SEQ ID NO: 532632 - DNA, 511 bp, Homo sapiens
  misc_feature: HEFZJCU01EAUUZ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttaccctcctatagtatcaactgggtgcgccaggccgctggacaacgacctgagtggatgggatgggcgaacccctaacactggtgtcacagtgtcttcacccatcctccgggacagacttaccatgaccacgaactcctccataaacacagcctacatggagttgaggagcctgacatctggacgacacgggccgtctattactgtgcgagagtcccagactccggtgagcctacggcaggcggcctttgacttcgtac

SEQ ID NO: 532633 - DNA, 511 bp, Homo sapiens
  misc_feature: HEFZJCU01BG8T5.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctgggagtggctcgcacttatttacagttggcggcacgtacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcatttacg

SEQ ID NO: 532634 - DNA, 517 bp, Homo sapiens
  misc_feature: HEFZJCU01BI3YO.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattagtacattaggaacactatagtccctgggggcccaggggaaccctcgtctaccgtctcctcagcctccaccagggcccatcggtccttcccctggccgcccg

SEQ ID NO: 532635 - DNA, 552 bp, Homo sapiens
  misc_feature: HEFZJCU01BLU2C.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaacgggcccatcggtcttcccccttcggccaccctccctcctaaacgaggcacctctggggggcctacgacgcggccctcggggctcggccttc

SEQ ID NO: 532636 - DNA, 496 bp, Homo sapiens
  misc_feature: HEFZJCU01ES28Y.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgta

SEQ ID NO: 532637 - DNA, 497 bp, Homo sapiens
  misc_feature: HEFZJCU01BBV0D.51.71.G05.1.454.heavy.3.raw
cgatcgtatacacgaccggtgctcgatttagtgtcgtcgcaagagagagggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacgacggctatgttttactgtgcgagagggaactcgattac

SEQ ID NO: 532638 - DNA, 528 bp, Homo sapiens
  misc_feature: HEFZJCU01CK1KB.11.25.C03.1.454.heavy.3.raw
cgagagataccacgaccggtgctcgatttagtagtgtagatttgggtttggggggagagagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgtaacgttactacgctatggacgtcgtggggaccaagggaccac

SEQ ID NO: 532639 - DNA, 530 bp, Homo sapiens
  misc_feature: HEFZJCU01DZBTX.3.70.G04.1.454.heavy.3.raw
agacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaaatgaacaacctgagaaccgagacacggccgtatattattgtgcgagtagtacggtggtgaatgtgggtgttaactggggcctgggaaccctggtcacgtctcctc

SEQ ID NO: 532640 - DNA, 523 bp, Homo sapiens
  misc_feature: HEFZJCU01ATV2Y.40.53.E09.1.454.heavy.3.raw
tctagcgactcacgaccggtgctcgatttagagagagtgtgttgggtttggggagcccccagagcacaactccttaccatggactggacctggaggatcctctttttggtggcagcagccacaggtgcccactcccaggtccagcttgtgcagtctggggctgaggtgaagaagcctggggcctcagtgagggtttcctgcaaggcgtctggatattccttcactacctacactctgcattggctgcgccaggcccccggacacagctttgagtggatggggtggctcaacgctggcgatggaaaaacaaatattcagagaagttccagggcagagtcaccattacaagggacacaatcgcgcgcaatgcttacatggagttgaggagcctgagatctgaagacacggctgtgtattactgtgtgagaggcggatattgtcgtggtggtgactgctacagtacaaaagtcgtcggtggttggtccgtaccccgtgggggtccaacggggtaacccctcgtccg

SEQ ID NO: 532641 - DNA, 523 bp, Homo sapiens
  misc_feature: HEFZJCU01B89RX.10.44.D11.1.454.heavy.3.raw
catagtagtgcacgaccggtgctcgatttagcgcagtacgaagggggggagaggagcccagcactagaagtcggcggtgtttccattcggtgatcagcactgaacacagaggactcaccatggagtttgggctgaactgggtttttcctcgttgctctttttaagaggtgtccagtgtcaagtgcaactggtggagtctggggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcctttgacgtctggggcc

SEQ ID NO: 532642 - DNA, 492 bp, Homo sapiens
  misc_feature: HEFZJCU01DE56H.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctcca

SEQ ID NO: 532643 - DNA, 522 bp, Homo sapiens
  misc_feature: HEFZJCU01DU3W4.18.39.D06.1.454.heavy.3.raw
  modified_base (458)..(458): a, c, t, g, unknown or other
  modified_base (465)..(465): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaatttttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggancacctcnggggcacacgcggccctgggcgtgcctggtccgaaggactaccttccctacttaccg

SEQ ID NO: 532644 - DNA, 516 bp, Homo sapiens
  misc_feature: HEFZJCU01DQZ1K.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtctctaagactctacctgtgcagcctctggactcaccttcacgctcaatggccactacgtggactgggtccgccaggctccagggaaggggctggagtgggttggccgttctagagaccacaactaacagtgacacccggcacaactacgccgcgtctgtgaaaggcagattcaccatctcaagagatgattcagagaactcactttatctgcaaatgaacagcctgagaaccgacgacacggccgtctattattgtgtcatacgacctaggactacgaacgtac

SEQ ID NO: 532645 - DNA, 400 bp, Homo sapiens
  misc_feature: HEFZJCU01C5504.11.70.G04.1.454.heavy.3.raw
cgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaagtaattgttagggacctccactacggtatggacgtctggggccaagggaccacggtcaccgtctcctcagcctccaccaagggcccatcggtcttccccctggcaccctcctccaagagcacctctggggcacagcggccctgggctgcctggtcaagggctacttccgtatctctcg

SEQ ID NO: 532646 - DNA, 519 bp, Homo sapiens
  misc_feature: HEFZJCU01BCL48.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctgaatgaacaatctgagagtcgacgatacggctgtctatctattgttgttttcgatgtccttcggtccgccggggacttcgtggggtccacggggtaacccg

SEQ ID NO: 532647 - DNA, 500 bp, Homo sapiens
  misc_feature: HEFZJCU01BW7TN.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgaccgtgggcccgccaggctccagggaaggggctggagtgggtctcagttattgaaacagatggcactacatattattctgactccgtgaagggccggttcacctctccagagacacttccaacaacatcttgtatcttcacatgcacaatctgagagtcgacgacacggccacctattattgtgcgcgacatgactacgctcaattcgtggggcc

SEQ ID NO: 532648 - DNA, 519 bp, Homo sapiens
  misc_feature: HEFZJCU01DOWMJ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacacgcctgagagccgatgacacggccgtgtattactgtgcgagagatggggcccacgaacgttactacgctatggacgtctggggccaagggaccg

SEQ ID NO: 532649 - DNA, 531 bp, Homo sapiens
  misc_feature: HEFZJCU01C8XOI.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtcctactaggtttgactactgggggacccaggggaagcgtttggtcacccgttctccctcacgcct

SEQ ID NO: 532650 - DNA, 505 bp, Homo sapiens
  misc_feature: HEFZJCU01CN7LQ.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtgcagttgtgtggtatgacggaagtaatagaaagtatgccgacgccgtgaagggccgattcaccatctccagagacaattccaacaacatgttgtatctgcaaatgaatagctgagagccgaggacacggctgtgtattacgtgtgtcagagagtgggaggggggtggtggatccgta

SEQ ID NO: 532651 - DNA, 560 bp, Homo sapiens
  misc_feature: HEFZJCU01EMCBH.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacatgtatcttcaaatgaataacctagagagccgaggacacggccatgtattactgtggtggggcatttaacgttgacccccgtggggggtcccggggggaaaccctcgggtcgacccggttcgtaccccccaccccttcccaaccctaaac

SEQ ID NO: 532652 - DNA, 504 bp, Homo sapiens
  misc_feature: HEFZJCU01BJKBJ.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctggggaggttccctgagactctcctgtacagcctctggcttcaccttcattacctatggcatgcactgggtccgccagactccaggcagggggctggagtgggtggcagttatttcatatgatggaaatagtgacttctattcagactcccgtgaagggccgattcaccgtctccagagacaattccaggcaacacgctgtatctgcaaatgaacagcctgagagctgaggacacggctgtgtattactgtgcgaaagatttctatagaggtgacgtacgggggcgttcg

SEQ ID NO: 532653 - DNA, 517 bp, Homo sapiens
  misc_feature: HEFZJCU01BUSTF.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggcgattcacatctccagagacaactccaggaacacaatgtatttggacctgaacagcctaagtcctgaggacacgggtgtatactactgtacgaagggaggggggaaccgaggcgggagtaccaagtactcctttg

SEQ ID NO: 532654 - DNA, 524 bp, Homo sapiens
  misc_feature: HEFZJCU01BSFF7.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagagacaattccaagaacacgatgtatctgcaaatggacagcctaagagttgaggacacggctgtttattactgtacgaaagaggggggatacagtggcagctccaagtactaactttgacttctggggccagggaaccctggtcaccgtctcctcagcctccaccaacgggcccatcggtccttccccctcggcgccctgctccaggagcacctccgacgagcacagcggccctcgggctgcctc

SEQ ID NO: 532655 - DNA, 504 bp, Homo sapiens
  misc_feature: HEFZJCU01C2236.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccgagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttggttgggcggatagcaggcgggtaccc

SEQ ID NO: 532656 - DNA, 507 bp, Homo sapiens
  misc_feature: HEFZJCU01BEATG.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctataggggatttggattcc

SEQ ID NO: 532657 - DNA, 518 bp, Homo sapiens; identical to SEQ ID NO: 490681
  misc_feature: HEFZJCU01BUZ5S.9.70.G04.1.454.heavy.3.raw

SEQ ID NO: 532658 - DNA, 525 bp, Homo sapiens
  misc_feature: HEFZJCU01DGMRT.52.74.G08.1.454.heavy.3.raw
cgcagtacgacacgaccggtgctcgatttagtagctctatcaggggatgctttctgagagtcatgggcctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagccccccgggaaggggctggagtggatcggcagcatccatcatagtggagacaataatcacaatccgtccctcagaggacgagtcaccttttcagtggagacgtccaagaaccaattctccctgaaattgacctctctgaccgccgccgaccacggccctttattactgtgcgcgagtgaacacagcaataacttattatgttgaatattggggccagggaaccccggtcaccatctcctcagcctaccgaccaagggcccagtcc

SEQ ID NO: 532659 - DNA, 395 bp, Homo sapiens
  misc_feature: HEFZJCU01BX8J9.47.46.E02.1.454.heavy.3.raw
agctcacgtacacgaccggtgctcgatttagactcatctacaggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttcccctggcgccctgctccaggagcacctccgagagcacagcggccctgggctgcctggtcaaggactacttcctacgtgagct

SEQ ID NO: 532660 - DNA, 512 bp, Homo sapiens
  misc_feature: HEFZJCU01DIG4U.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatgaccacgaactcctccataaacacagcctacatggagttgaggagcctgacatctgacacacggccgtctattactgtgcgagagtcccacgatccggtgacgcctacggcaggcggccttttgacttcgtggggccgaggggacg

SEQ ID NO: 532661 - DNA, 511 bp, Homo sapiens
  misc_feature: HEFZJCU01B5QTZ.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgacgaaccgacgacgacggccgtctattattgtgtcataagacctaggatacaacggac

SEQ ID NO: 532662 - DNA, 503 bp, Homo sapiens
  misc_feature: HEFZJCU01AIN9S.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagagtggggcccacgaacgttactacgctagtggacgtc

SEQ ID NO: 532663 - DNA, 483 bp, Homo sapiens; identical to SEQ ID NO: 444532
  misc_feature: HEFZJCU01C7OMF.47.59.F04.1.454.heavy.3.raw

SEQ ID NO: 532664 - DNA, 533 bp, Homo sapiens
  misc_feature: HEFZJCU01A62JP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtggggtggcacttattgcacatgatggcgtcaacaaattctacgcaaattccgtgaggggccgattcaccatctccagagacaattacaagaacaccctttatctgcaaatagacagcctgagaccagacgacacggctgtctacttattgcgcgagagagacacacgaacctactggccaatactatgggggcttggttctggggtccaggggaccctggtcatcgtcctccccagcctccaccaacggcccatccggtcttcccctggccgcctcg

SEQ ID NO: 532665 - DNA, 514 bp, Homo sapiens
  misc_feature: HEFZJCU01B2W5K.49.81.H04.1.454.heavy.3.raw
agtcgagagacacgaccggtgctcgatttagtagtgtagattcgcgggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgacgagctgaggacacggctatttattactgtgcgaacttaatcacggaggacaaggggtcgacccccgtccg

SEQ ID NO: 532666 - DNA, 508 bp, Homo sapiens
  misc_feature: HEFZJCU01ARKUT.53.54.E10.1.454.heavy.3.raw
cgcgtatacacacgaccggtgctcgatttagatcgtagcagaacacacaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtccgggggaggcgtggtccaggcctgggaggtccctgagactctcctgtgtagcctctggattcaccttcagggtctatggcatgaactgggtccgccagactccaggcaaggggctggagtgggtggcatttatatcatttgatggcactaataaatactatgcagactccgtgaggggccgattcaccatctccagagacaattccagaacatgtgttctgcaaatgaacagcctgagagttgaagacacggctgtgtattactgtgcgaaacggaatgagtggggaactaggggtcg

SEQ ID NO: 532667 - DNA, 487 bp, Homo sapiens
  misc_feature: HEFZJCU01BRH7J.4.57.F02.1.454.heavy.3.raw
  modified_base (424)..(424): a, c, t, g, unknown or other
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgatttcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccagggcccatcggtcttccctggcgcctgctcnggagcacctctgggggcacagcggccctgggctgcctggtcaggactacttccctacagtgct

SEQ ID NO: 532668 - DNA, 499 bp, Homo sapiens
  misc_feature: HEFZJCU01DIH5I.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacggcccctggacaagggcttgagtggatgggacggatcagccctaacagtggtggcacaaactatgcacagaggtttcagggcaggggtcaccatgaccagggacacgtcccatcagtacagcctacatggagctgagcagtctgagacctgacgacacggccgtgtattattgtgcgttagttacggacgattacgacgttttgattggt

SEQ ID NO: 532669 - DNA, 489 bp, Homo sapiens
  misc_feature: HEFZJCU01D5HL7.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgagtcggggggagcgtggcccagcctgggagtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaacctccaacaacacactggatctccaaatgaacagcctgagagtcgaggacacggccgtatattattgtgcccgttgacttacta

SEQ ID NO: 532670 - DNA, 522 bp, Homo sapiens
  misc_feature: HEFZJCU01C6CPL.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctgacttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtagtatcttacaaatgaacaacctgagagccgacgacacggtccgtttattactgtgcgagagattcgagtggttcggggacctcaccctggttctacttcgatctcgtc

SEQ ID NO: 532671 - DNA, 504 bp, Homo sapiens
  misc_feature: HEFZJCU01BHBES.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccaggcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctggaggacacggctgtgtattactgtgacgaaagatttctataggaggtgacgtacgggggcgtttcg

SEQ ID NO: 532672 - DNA, 514 bp, Homo sapiens
  misc_feature: HEFZJCU01BE8RC.52.24.C02.1.454.heavy.3.raw
cgcagtacgacacgaccggtgctcgatttagtacagatcgttagggaaaggggctctgagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccgggggggtccctgagactctcctgtgcagcctctggattcaccttcagcagttatagcatgaactgggtccgccaggctccagggaagggctggagtgggtctcatttattagtactagttacttatactacgcagactcagtgaagggccgattcaccatctccagagacaacgccaggaattcactatatttgcaaatgaacagcctgcgagccgaggacacggctgtgtattactgtgcgcgagaacacagcaatcggacctattcgactacgtggggtaccg

SEQ ID NO: 532673 - DNA, 500 bp, Homo sapiens
  misc_feature: HEFZJCU01AREE4.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatcgactcgtcccccggactttacg

SEQ ID NO: 532674 - DNA, 519 bp, Homo sapiens
  misc_feature: HEFZJCU01B2RWC.49.23.C01.1.454.heavy.3.raw
agtcgagagacacgaccggtgctcgatttagtacacgtgattagggattggggcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactatttcatggaactgagcagcctcagatccgaggacacggccgtttactactgtgcgagcgatcccggattcccgcgtttcgaggatgactactggggccagggaaccctggtcaccgtctcctcagcctccaccaagggcccatccggtcttccccctggcaccctcctccagagcgacctctggggggcacgagccgggccctgggctgcc

SEQ ID NO: 532675 - DNA, 500 bp, Homo sapiens
  misc_feature: HEFZJCU01DMCWF.48.39.D06.1.454.heavy.3.raw
  modified_base (462)..(462): a, c, t, g, unknown or other
agtatacatacacgaccggtgctcgatttagtgacatctcgcagttctttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgngggcaggacaatggtcaccgtctcttcagcctccaccg

SEQ ID NO: 532676 - DNA, 510 bp, Homo sapiens
  misc_feature: HEFZJCU01B8L9M.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttaggactctcctgtgcagcctctggattcactttcagtaacgcctggatgaactgggtccgccaggctccagggaaggggctggagtggggttggccatattaaaatcaaagctgatggtggggacaacagagcacgctgcacccgtgaaaggcagattcagcatctcaagagatgatacaaaaagtacgctgtatctgaacatgaacagcctagaaaacggaggacacagccgtagtattactgtcgccactcaggaccgatactttgtt

SEQ ID NO: 532677 - DNA, 507 bp, Homo sapiens
  misc_feature: HEFZJCU01DKLAY.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagttgaccactccacgctggttcgacctctggggccac

SEQ ID NO: 532678 - DNA, 515 bp, Homo sapiens
  misc_feature: HEFZJCU01B3KDL.11.13.B02.1.454.heavy.3.raw
  modified_base (476)..(476): a, c, t, g, unknown or other
  modified_base (501)..(501): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctcccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctnctccaggagcacctccgacgagcanagcggcctggctcg

SEQ ID NO: 532679 - DNA, 518 bp, Homo sapiens
  misc_feature: HEFZJCU01EOIZJ.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtcccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgagacacgggtgtatactactgtacgaaggaggggggaaccgagcgggacgttccaagtactcctttg

SEQ ID NO: 532680 - DNA, 508 bp, Homo sapiens
  misc_feature: HEFZJCU01DY3WK.12.55.E11.1.454.heavy.3.raw
  modified_base (489)..(489): a, c, t, g, unknown or other
  modified_base (494)..(494): a, c, t, g, unknown or other
atacgacgtacacgaccggtgctcgatttagcactcgcacgttgggtttgggctgagctgggttttcctcgttgctcttttaagaggtgtccagtgtcagatgcagctggtggagtctggggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctcgtgggccgtggcacctggtcactgtctcctcggcttccaccaggccatcggtcttcccctggcncctcnctccagagcactcg

SEQ ID NO: 532681 - DNA, 532 bp, Homo sapiens
  misc_feature: HEFZJCU01CD2IN.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccatcctcgggacagacttaccatgaccacgaactcctccataaaccacagcctacatggagttgaggagcctagacatctggacgacacgggccgtctattactgtcggcgtagacgtaccccacggacttccgggtaggacgcccgtaacgggccaggccgggtccctttggacctttcgtc

SEQ ID NO: 532682 - DNA, 528 bp, Homo sapiens
  misc_feature: HEFZJCU01CJ2DD.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacaccgaacctactggccaatactatgggggcttgttctgggggccaggggaccctggtcatcgtctccccagccctccaccaacgggcccatccggtcttccccctggccg

SEQ ID NO: 532683 - DNA, 513 bp, Homo sapiens
  misc_feature: HEFZJCU01DR4NF.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattggggccgacggaaccttgactacgtggggccagggaaccctggtccaccgt

SEQ ID NO: 532684 - DNA, 500 bp, Homo sapiens
  misc_feature: HEFZJCU01AXY6L.51.38.D05.1.454.heavy.3.raw
cgatcgtatacacgaccggtgctcgatttagtatctgatagttgggtttgggggggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccgattcaccatctccagagacagttccgatgacacagtctatctacacaatgagcagtgtagagactgacgacacggctctttttactgttgcgccaggaagcgagtggctggccacgta

SEQ ID NO: 532685 - DNA, 515 bp, Homo sapiens
  misc_feature: HEFZJCU01DSZ79.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggaggtccaagtactt

SEQ ID NO: 532686 - DNA, 512 bp, Homo sapiens
  misc_feature: HEFZJCU01B68UI.9.33.C11.1.454.heavy.3.raw
tgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacacgcctaagagttgaggacacggctgtttattactgtacgaaaggaggggggagtacgagtggcagctccaagtactacttt

SEQ ID NO: 532687 - DNA, 519 bp, Homo sapiens
  misc_feature: HEFZJCU01D5BKY.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaaggccgattaaccatctccagagacgattccgagaacacggtgtaatcttcaaatgaacaacctgagagccgacgacacggccgttaattactgtgcgagagatgacgtggttcggggacctcaccctggttctacttcgatctcgtc

SEQ ID NO: 532688 - DNA, 395 bp, Homo sapiens
  misc_feature: HEFZJCU01BKCAI.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttcttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 532689 - DNA, 495 bp, Homo sapiens
  misc_feature: HEFZJCU01D41H0.19.1.A01.1.454.heavy.3.raw
tactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagccccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctatttttgtgcgacagaaagagattcccatactcaggcggggcactatggcagc

SEQ ID NO: 532690 - DNA, 513 bp, Homo sapiens
  misc_feature: HEFZJCU01EPHZJ.49.81.H04.1.454.heavy.3.raw
agtcgagagacacgaccggtgctcgatttagtagtgtagattcgcggggtctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacatccaagaacacgctatatttgcacatgaacagcctgagagctggaggacacggctatttattactgtgcgaacttaatcaacggaggacgagggtgacccccgtcactcc

SEQ ID NO: 532691 - DNA, 495 bp, Homo sapiens
  misc_feature: HEFZJCU01C3W9W.51.35.D02.1.454.heavy.3.raw
cgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaaggccgattgaccatctccagagacaactcgaagatacggtcttctacaaatgaacagcctgagagctgaggacacggctatgttttactgtgcgagagggaactcgatttacag

SEQ ID NO: 532692 - DNA, 505 bp, Homo sapiens
  misc_feature: HEFZJCU01ERLT0.17.10.A10.1.454.heavy.3.raw
  modified_base (452)..(452): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacgggacacccccacgaaccacagtctacatgcaactgacgagcctgagagctgacgacacggccgtctattactgtgcganaattgttttctgtcatcgtacaatttgataggctctatggactggacttcgtc

SEQ ID NO: 532693 - DNA, 536 bp, Homo sapiens
  misc_feature: HEFZJCU01D8AM6.12.11.A11.1.454.heavy.3.raw
atacgacgtacacgaccggtgctcgatttagctacgactgcagggggtctcagagaggagccttagccctggactccaaggcctttccacttggtgatcagcactgagcacagaggactcaccatggaattggggctgagctgggttttccttggttgctattttagaaggtgtccagtgtgaggtgcagctggtggagtctggggggaggcttggtccagcctgggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggtacgtcctacgggttgactaaaagttttattacaaaaccaggaacaaaggttcgttccg

SEQ ID NO: 532694 - DNA, 504 bp, Homo sapiens
  misc_feature: HEFZJCU01B0NHN.53.8.A08.1.454.heavy.3.raw
  modified_base (457)..(457): a, c, t, g, unknown or other
cgcgtatacacacgaccggtgctcgatttagcatactctacaggggctgggagaggagcccagcactagaagtcggcggtgtttccattcggtgatcagcactgaacacagaggactcaccatggagtttgggctgagctgggttttcctcgttgctcttttaagaggtgtccattgtcaggtgcagttggtggagtcggggggatctgtggtccggcctgggaggtccctgagactctcctgtacagcctccggattcagcttcgagaactatggcttgcactgggtccgccaggctccaggcaaggggctggagtgggtggcagttatttcatatgattcaagtattggatattacgcagactctgttaagggccgattcaccatctccagagacaattccaagaacaccctgtatctgcaattgagcagactcacagctgaggacacggctgtntattactgtgtgaaagacgtttatgagagtagtggttttcgagtacg

SEQ ID NO: 532695 - DNA, 526 bp, Homo sapiens
  misc_feature: HEFZJCU01EM4WX.40.68.G02.1.454.heavy.3.raw
tctagcgactcacgaccggtgctcgatttagtcgatagtgaagggaaaggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaaagtcgaggcaccatatccgtagacacgtccaagaaccaattctccctgaagctgagctctgtgaccgccgcagacacggctgtctattactgtgcgaggccccgagcgcagtggtctttttgtatgtcccgtttgattatgtcgggggtccaaagggggacaagtggtcgaaccgttctccttctaagcccttccaccc

SEQ ID NO: 532696 - DNA, 496 bp, Homo sapiens
  misc_feature: HEFZJCU01CO8SZ.49.5.A05.1.454.heavy.3.raw
agtcgagagacacgaccggtgctcgatttagatagatagacagggggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcaccatctcccgacacaattccaagaacacattgtttctactgctgaacagcctgagaagtgacgacacggctgtatatcactgtgcggcaggcaacgattactacccgaaggactac

SEQ ID NO: 532697 - DNA, 535 bp, Homo sapiens
  misc_feature: HEFZJCU01ELUB2.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacggggcgtttattactgtgcgaggaggggacggacgtacggtgactacgtgggggttccgaccccgtgggccgagggaacccgtggtcaccgtctcctcacgcctccaccg

SEQ ID NO: 532698 - DNA, 508 bp, Homo sapiens; identical to SEQ ID NO: 445594
  misc_feature: HEFZJCU01D1YP9.17.25.C03.1.454.heavy.3.raw

SEQ ID NO: 532699 - DNA, 522 bp, Homo sapiens
  misc_feature: HEFZJCU01BBCSF.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagacgggagttccgaagtacttcctttgtacgtctc

SEQ ID NO: 532700 - DNA, 515 bp, Homo sapiens
  misc_feature: HEFZJCU01ATQMZ.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagctgagagccgatgacacggccgtgtattactgtgcgagagagtggggcccacgaacgttactacgctagtggacgtcgtggggacc

SEQ ID NO: 532701 - DNA, 507 bp, Homo sapiens
  misc_feature: HEFZJCU01DCR3E.49.5.A05.1.454.heavy.3.raw
agtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtgcagttatatcgtatgatggaaacgaaaatactacgcagactccgtgaagggccgattcaccatctcccgacacaattccaagaacacattgtttctactgctgaacagcctgagaagtgacgacacggctgtatatacactgtgcggcaggcaacgattacacccgaaggactacgtcggggcc

SEQ ID NO: 532702 - DNA, 531 bp, Homo sapiens
  misc_feature: HEFZJCU01AXUB7.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagcgatgacacggccgtgtatactgtgcgagagatgggggcccacggaaccgttactacgctagtaggacgtctgggggccaaggggaccac

SEQ ID NO: 532703 - DNA, 499 bp, Homo sapiens; identical to SEQ ID NO: 491457
  misc_feature: HEFZJCU01DRVJW.51.78.H01.1.454.heavy.3.raw

SEQ ID NO: 532704 - DNA, 520 bp, Homo sapiens
  misc_feature: HEFZJCU01A7L5R.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccaggggaacggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccgggatattgttatagaaccacctgctatctgagtctggttcgactgcgtggggccacggggaaccctggtctacccg

SEQ ID NO: 532705 - DNA, 496 bp, Homo sapiens; identical to SEQ ID NO: 444697
  misc_feature: HEFZJCU01DP61W.16.37.D04.1.454.heavy.3.raw

SEQ ID NO: 532706 - DNA, 422 bp, Homo sapiens
  misc_feature: HEFZJCU01APBX5.51.30.C08.1.454.heavy.3.raw
cgatcgtatacacgaccggtgctcgatttagtctgacgtcaaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcacctcctccaagagcacctctgggggcacagcgccctgggctgcctggtcaaggactacttcctcgtagcact

SEQ ID NO: 532707 - DNA, 510 bp, Homo sapiens
  misc_feature: HEFZJCU01BPKT2.11.71.G05.1.454.heavy.3.raw
  modified_base (455)..(455): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctgggagtgggtggcagttatttcattatgatggaaatagtgacttctattcagactccgtgaagggccgattcaccgtctccagagacaattccaggcacacgctgtatctgcaaatgaacagcctgagagctgaggacacgggctggtntattactgtgacgaaagtatttactataggtaggtgacgtacggggggtcgttcg

SEQ ID NO: 532708 - DNA, 528 bp, Homo sapiens
  misc_feature: HEFZJCU01D8KVO.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattgggagtggggtggcaggttgtttcatctgagggcagtgttcaatggtatgcagactccgtgaagggccgattcaccatctccagagacaattccaggaacacaatgtatttaggaatagaacagcctaagtcctgaggacacgggtgtatactactgtacgaagggaggggggaaccgaaggcgggagttccgtaagtacttccg

SEQ ID NO: 532709 - DNA, 533 bp, Homo sapiens
  misc_feature: HEFZJCU01D1SQX.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattaaaagaacaccctttatctgcaaatagacagcctgagaccagacgacacggctgtctattattgcgcgagagagacacacgaacctactggccaatactatgggggcttgttctggggccagggggaccctggtcatcgtctcccagccctccaccaagggcccatccggtccttccccctcggcgcccctgt

SEQ ID NO: 532710 - DNA, 530 bp, Homo sapiens
  misc_feature: HEFZJCU01CT2OB.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacggcttctacttctgtgcgaggagtaattactataacactgcttccttttacaccttccctgtacttcgtgggccatcggaacccggtccg

SEQ ID NO: 532711 - DNA, 507 bp, Homo sapiens
  misc_feature: HEFZJCU01BHYZ2.40.44.D11.1.454.heavy.3.raw
  modified_base (498)..(498): a, c, t, g, unknown or other
tctagcgactcacgaccggtgctcgatttagcgcagtacgaagggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgcctagcccccagggaaggggctggagtggattggggaaatcaatcatagtggaagcaccaactacaacccgtcactcaagagtcgactcaccatatcagtagacacgtccaagaaccagttctccctgaagctgagctctgtgaccgccgcggacacggctgtgtattactgtgcgagaggcttggtagcagtggctcccgggggctttgactactggggccagggaacctggtcaccgtctcctcngcctccacc

SEQ ID NO: 532712 - DNA, 522 bp, Homo sapiens
  misc_feature: HEFZJCU01CFEAM.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctgggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacactcactgtctctgctgatgagcagcctgagagccgacgacacggctatctattactgtgacgaaactcgactacttccgttcattctgaatacgtggggcccaaggggaacccctgggtccgtcc

SEQ ID NO: 532713 - DNA, 485 bp, Homo sapiens
  misc_feature: HEFZJCU01AG2HV.48.68.G02.1.454.heavy.3.raw
agtatacatacacgaccggtgctcgatttagtcgatagtgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagccctacatggagctgagcagcctgagatctgaggacacggccgtgtattactgtgcgagagatcagagtggtttattatctcc

SEQ ID NO: 532714 - DNA, 534 bp, Homo sapiens
  misc_feature: HEFZJCU01DYWW1.12.40.D07.1.454.heavy.3.raw
atacgacgtacacgaccggtgctcgatttagtgatagagcgtaacaacagagggctcaccatggagtttgggctgagctgggttttcctcgttgctctttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatcttcaaatagacagcctgagaccagacgacacggctgtctattattgcgcgagacgagacacacgaacctactggccaatactatgggggctttggttctggggccagggggaccctgggtcatcgtctccccagccctccaccaagggcccatcggtcttcccctggccgccctg

SEQ ID NO: 532715 - DNA, 496 bp, Homo sapiens
  misc_feature: HEFZJCU01BE730.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagtttgagcagcctgagatctgacgacacggccgtttattactgtgcgcgagataatagtcacactggaacggtcgttttggggt

SEQ ID NO: 532716 - DNA, 529 bp, Homo sapiens
  misc_feature: HEFZJCU01C06G4.16.86.H09.1.454.heavy.3.raw
  modified_base (405)..(405): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctacaagagtcgagttaccatttcattaaacacgtctaagaaccagttctccctgaagctgacctttgngactgccgcggacacggccgtgtattactgtgcgagagacccctcgatagcagtggctggtccacttaggtttgacttacgtgggggacccaggggaagtcgtttggtccaccgtctcctcacg

SEQ ID NO: 532717 - DNA, 371 bp, Homo sapiens
  misc_feature: HEFZJCU01A9OOO.49.69.G03.1.454.heavy.3.raw
agtcgagagacacgaccggtgctcgatttagtcgctgcgtaaaggagaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcgcctctcttgagtactggggccagggatccctggtcatcgtctcctcagcctcaccaagggcccatcggtcttccccctggcgcctgctccaggagcacctccgagagcacagcggcctgggctgcctggtcaaggactacttcctctctcgact

SEQ ID NO: 532718 - DNA, 506 bp, Homo sapiens
  misc_feature: HEFZJCU01CFR8I.3.17.B06.1.454.heavy.3.raw
  modified_base (483)..(483): a, c, t, g, unknown or other
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacacacacaatacgccgcgtctgtgaaggcagattcaccatctcaagagatgatttcagagaactcactttatctgcaaatgaacagcctgagaaccgacgacacggccgtctattattgtntcatagacctaggatacaacgac

SEQ ID NO: 532719 - DNA, 512 bp, Homo sapiens
  misc_feature: HEFZJCU01C931A.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctcgctccaggagcacctccgagacgcacagcggccctgggctgcctggtcaaggactacttccagacgtatca

SEQ ID NO: 532720 - DNA, 496 bp, Homo sapiens
  misc_feature: HEFZJCU01BFDAF.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggtttttcctcgttgctctttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatcttccagagacaattccaagaacacgcagtatctgcaaatgaacagcctgacgagctgaggacacggctgtgtattactgtgggagagatggagtcggatattgt

SEQ ID NO: 532721 - DNA, 416 bp, Homo sapiens
  misc_feature: HEFZJCU01AXANO.14.74.G08.1.454.heavy.3.raw
cgtctagtaccacgaccggtgctcgatttagtagctctatcagggaagggactggagtggattggcaatatgcatgacagtggggcaccaactacaacccctccctcaagagtcgagtcaccttatcactagacgcgtccaagaagcagttctccctgaagctgagctctgtgaccgccgcagacacggccgcgtatttctgtgcgagacccggggagacggttttactatgaaaaggtcgttctgcacatattgttggtggttttgatgtctgggccaggggacaatggtcaccgtctcttcagcctccaccaagggcccatcggtcttccccctggcaccctcctccaagagcacctctgggggcacagccggccctgggcctgcctggtcaaggactacttccgtactagacg

SEQ ID NO: 532722 - DNA, 477 bp, Homo sapiens
  misc_feature: HEFZJCU01BQNA7.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtgcacaaagtatgcacagaagtttcagggcagggtcaccatgaccagggacacgtccatcagcacgtccatcagcacagcctacatggacctgagcggcctgacatctgacgacacggccgtatattctgtgcgaggg

SEQ ID NO: 532723 - DNA, 491 bp, Homo sapiens
  misc_feature: HEFZJCU01BU5RE.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaagggccgattcaccaatctccagagacaactccaagaacactctgtttctccaaatgaacagcctgagaggcgaggacacggcagtgtattatgtgcgagagatcgacatgtaacg

SEQ ID NO: 532724 - DNA, 506 bp, Homo sapiens
  misc_feature: HEFZJCU01EWGL6.47.38.D05.1.454.heavy.3.raw
  modified_base (461)..(461): a, c, t, g, unknown or other
  modified_base (468)..(468): a, c, t, g, unknown or other
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacgacggtccgtgtaattnttgtcgngttagtttacggacgtattacggtacgttttgattggt

SEQ ID NO: 532725 - DNA, 503 bp, Homo sapiens
  misc_feature: HEFZJCU01EQ0XK.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcggggtcaccatatcagtaggacacgtcccaagagccagttctccctgaagctgagggctgtgagcgccgcgagacacggccgtgtattacgtgtgcgagactggccgcaacagactacggtggcaacctctaatgctttgatatctggggccaggac

SEQ ID NO: 532726 - DNA, 505 bp, Homo sapiens
  misc_feature: HEFZJCU01BR69X.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccctggggccagggaaccctggtcaccgtctcctcagcctccaccaaggcccatcggtcttcccctggcaccctcctccaagagcacctctgggggcacagcggccctgggctgctggtcaggactacttcctacgtcgtat

SEQ ID NO: 532727 - DNA, 498 bp, Homo sapiens; identical to SEQ ID NO: 516188
  misc_feature: HEFZJCU01BUSXL.16.37.D04.1.454.heavy.3.raw

SEQ ID NO: 532728 - DNA, 523 bp, Homo sapiens
  misc_feature: HEFZJCU01CN5B7.12.11.A11.1.454.heavy.3.raw
atacgacgtacacgaccggtgctcgatttagctacgactgcagggggtctcagagaggagccttagccctggactccaaggcctttccacttggtgatcagcactgagtacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggacgtcctaggtcgacaaatttattcaaacctagaaccaagttacgttcg

SEQ ID NO: 532729 - DNA, 534 bp, Homo sapiens
  misc_feature: HEFZJCU01BI52Z.7.70.G04.1.454.heavy.3.raw
  modified_base (418)..(418): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccncggacacgggctttattactgtgcgagaggggacggactacggtgactacgtgggggtttccgaccccgtggggccaggggaacccctggtcaccgtctcctcagcctccgaaccg

SEQ ID NO: 532730 - DNA, 506 bp, Homo sapiens
  misc_feature: HEFZJCU01BG73Y.48.81.H04.1.454.heavy.3.raw
  modified_base (470)..(470): a, c, t, g, unknown or other
agtatacatacacgaccggtgctcgatttagtagtgtagattcgcgggggcatcacatagcaaccacgttcctcccctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggccccctggacacgggcttgagtggatgggatcgatcatccctttctctaatgtcacaagatacacacagagattccagggcagaatcacacttaccgcggacaaatccacgggcacagcgcagttggacctgagcggcctgagactgagacacggcattactactgtgcggcgggaggtggacggngcttcggttttcggagtttatcgatctactactttg

SEQ ID NO: 532731 - DNA, 534 bp, Homo sapiens
  misc_feature: HEFZJCU01B69CP.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggctatttacttcgacccctgggggcccgggggaaccctggtcaccgtctccccaccctccaccg

SEQ ID NO: 532732 - DNA, 525 bp, Homo sapiens
  misc_feature: HEFZJCU01B9DVE.15.55.E11.1.454.heavy.3.raw
tctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtctgggggaggcttggtacagcctggggggtccctgagactctcctgtgcagcctcaggattcgcctttcgcatctatgccatgacctgggtccgccaggctccagggaaggggctgggagtggatctcagctattagtggaggtggtagtggtagaaaacacatattacgcaggctccgtgaagggccgcttcaccatctccagagacaattccaacaacacactttatcttacaaatgaacagcctgcgagccgaggacacggccgtatactactgtgcgagagatacgaacaggcccgtgggacgtcccggtgactacgtc

SEQ ID NO: 532733 - DNA, 515 bp, Homo sapiens
  misc_feature: HEFZJCU01AYZHP.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctgggagtgggtggccaacataaacaagacggaagtcagaaaaactatgtggactctgtgaacggccgattcaccatctccagagacaacgccaagaattcactgtatttgcaaatgaacagcctgagaggcggaggacacgggccgtgtattattgtgcgcgagatgatagtaggactctacagtagcagggtgta

SEQ ID NO: 532734 - DNA, 507 bp, Homo sapiens; identical to SEQ ID NO: 462006
  misc_feature: HEFZJCU01ATZE9.10.88.H11.1.454.heavy.3.raw

SEQ ID NO: 532735 - DNA, 519 bp, Homo sapiens
  misc_feature: HEFZJCU01DNKWQ.51.3.A03.1.454.heavy.3.raw
cgatcgtatacacgaccggtgctcgatttagagagcgtcacaggggtctcagagaggtgccttagccctggattccaaggcatttccacttggtgatcagcactgaacatagaggactcaccatggagttggggactgtgctgggttttccttgttgctattttagaaggtgtccagtgtgaggtgcggctggtggagtctgggggaggcttggtacagcctggggggtccctgacactctcctgtgcagcctctggattccccttcagaacttatgaaatgaactgggtccgacaggctccagggaaggggctggagtgggtttcacacattagtagtggtggaagtaccatattctacgcagactttgtgcagggccgattcaccatctccagagacgacgccaagaattcactgtatctgaaaatgaacagcctgagagccgacgacacggctgtttattactgtgcgagagattactatcatagtagttggttttttcctacttactccggtatc

SEQ ID NO: 532736 - DNA, 503 bp, Homo sapiens
  misc_feature: HEFZJCU01EYGFZ.51.40.D07.1.454.heavy.3.raw
cgatcgtatacacgaccggtgctcgatttagtgatagagcgtaacaacagagggggctctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcgaacttatcacggaggacaaacc

SEQ ID NO: 532737 - DNA, 512 bp, Homo sapiens
  misc_feature: HEFZJCU01DS3HN.52.39.D06.1.454.heavy.3.raw
cgcagtacgacacgaccggtgctcgatttagtgacatctcgcagttctttgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagtggtactttttactacagttggagtcgccagcccccagggaagggactagagtggattgggagtgttcatcataatgggaggaccttctacagcccgtccctcaagagccgagtcaccatatcaatggacacgtccaggaaccacctctccctcgaacctcaactctgttacggccgcggacacggccgtgtattattgtgcgagggaggcccaaaatggtggcgactcgccttcacttgacctctggggccaggggaaggctggtcatcgtct

SEQ ID NO: 532738 - DNA, 303 bp, Homo sapiens
  misc_feature: HEFZJCU01B99Q8.51.32.C10.1.454.heavy.3.raw
  modified_base (193)..(193): a, c, t, g, unknown or other
  modified_base (262)..(262): a, c, t, g, unknown or other
cgatcgtatacacgaccggtgctcgatttagtatagacatcaacacacaaaggggagctctgggagaggagccccaggcccgggattcccaggtgtttccattcagtgatcagcactgaagacagaagactcatcatggagttctggctgagcgtggttcgtcctaggttgccattttaaaagatgtccagtntgaggtgcggctagatagaatctggggagcttggtccgagcctgggggtccctgagactctcctcgttnacgcctcgtggtatctaaccttcagtaggaatccctatgca

SEQ ID NO: 532739 - DNA, 536 bp, Homo sapiens
  misc_feature: HEFZJCU01EHH5P.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtccttccccctggcaccctcctccaagagcacctcgtc

SEQ ID NO: 532740 - DNA, 500 bp, Homo sapiens
  misc_feature: HEFZJCU01A59AG.51.81.H04.1.454.heavy.3.raw
cgatcgtatacacgaccggtgctcgatttagtagtgtagattcgcggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggctggtccaggctgggaggtccctgagactctcctgtgcagcctctggattcaccttcagtacccatgaaatgcactgggtccgccaggctccaggcaaggggctggagtgggtgcagttatatcctatgatggaagcaatagcactacgcagagtccgtgaagggccgattgaccatctccagagacaactcgaagaatacggttcttctacaaatgaacagcctgagagctgaggacacggctatgtttactgtgcgagagggaacctcgattacgagcacgcccg

SEQ ID NO: 532741 - DNA, 514 bp, Homo sapiens
  misc_feature: HEFZJCU01CN2BT.11.13.B02.1.454.heavy.3.raw
  modified_base (479)..(479): a, c, t, g, unknown or other
  modified_base (484)..(484): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcgagggaactctggtcaccgtctcctcagcctccacaacggccatcggtctcccctggccgcctcgctccngagcncctccgagagcacagcggccctcgggctcg

SEQ ID NO: 532742 - DNA, 520 bp, Homo sapiens
  misc_feature: HEFZJCU01DFR1H.9.33.C11.1.454.heavy.3.raw
tgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtagaagggccatcaccatctccagagacaattccaagaacacgatgtatctgcaaatggacagacctaagagttgaggacacggctgtttattactgtacgaaaggaggggggatacgagtggcagctccaagtactacttttacg

SEQ ID NO: 532743 - DNA, 510 bp, Homo sapiens
  misc_feature: HEFZJCU01EPIQE.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaaccaacacagcctacatggaactaaggggactgacatctgacgacacggccatgtattattgtgcgagaagaaatgttagtactgtctttgggtccctgggggcccgggaacccgggtc

SEQ ID NO: 532744 - DNA, 534 bp, Homo sapiens
  misc_feature: HEFZJCU01D5DM6.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctaattattggttgtcataacgacctaaggataacaacggaacggttggtaccttggtaagtttcc

SEQ ID NO: 532745 - DNA, 501 bp, Homo sapiens
  misc_feature: HEFZJCU01D0NYW.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagacgcacagcggccctgggctgcctggtcaaggactacttccgtactagacg

SEQ ID NO: 532746 - DNA, 520 bp, Homo sapiens
  misc_feature: HEFZJCU01EYG3S.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatgggagttgagggagcctgacatctgacgacacggccgtctatttactgtgcgagacgtcccagtactccgggtgacgcctaccgggcaggccgggccttttggacctttcgtc

SEQ ID NO: 532747 - DNA, 514 bp, Homo sapiens
  misc_feature: HEFZJCU01A5XHW.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagtttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccaggggaagggcctggagtgggtctcaggtattagtccggaatagtggtagcataggctatgcggactctgtgaagggccgattcaccatctccagagacaacgccaagaactccctgtatctgcaaatgaacagcctgagagctgaggacacggccttgtattattagtgcaaagataccaccctacgtacttttggagtggttacg

SEQ ID NO: 532748 - DNA, 519 bp, Homo sapiens
  misc_feature: HEFZJCU01BFQ4Q.53.49.E05.1.454.heavy.3.raw
cgcgtatacacacgaccggtgctcgatttagagcgactagcaacacacaaagggggggagaggagcccagcactagaagtcggcggtgtttccattcggtgatcagcactgaacacagaggactcaccatggagtttgggctgaactgggttttcctcgttgctcttttaagaggtgtccagtgtcaggtacaactggtggagtctgggggaggcgtggtccagcctgggaggtccctgagactctcctgtgcagcctctggattccccttccatgtatttgccatgcattgggtccgccaggctccaggcaaggggctggagtgggtggcagttatatcctttgatggaagtaacaaatattatggagagtccatgaagggccgattccaccatctccagagacaattccaagaacatagtgtatctgcaaatgaacgcctgagaggtgacgacacggctgtgtattactgtgcgaaagataatcccccggacctgagtcttttggtagaagctaacg

SEQ ID NO: 532749 - DNA, 398 bp, Homo sapiens
  misc_feature: HEFZJCU01AULUB.47.46.E02.1.454.heavy.3.raw
agctcacgtacacgaccggtgctcgatttagactcatctacagggaaaggggctggagtgggtctcaagtattgatgagaatggtggaagcacttattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 532750 - DNA, 520 bp, Homo sapiens
  misc_feature: HEFZJCU01C68B7.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtctaccgtctaccgcacgcctccaccaacggcccatcc

SEQ ID NO: 532751 - DNA, 379 bp, Homo sapiens; identical to SEQ ID NO: 445912
  misc_feature: HEFZJCU01EYPTD.47.77.G11.1.454.heavy.3.raw

SEQ ID NO: 532752 - DNA, 494 bp, Homo sapiens
  misc_feature: HEFZJCU01DSL0D.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacgacggctgtgtattactgtgggagagatggaggtcgatattgtt

SEQ ID NO: 532753 - DNA, 543 bp, Homo sapiens
  misc_feature: HEFZJCU01E0G0H.19.86.H09.1.454.heavy.3.raw
tactctcgtgcacgaccggtgctcgatttagtgctatagacttgggtttgggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctgggccagggaaccctggtcaccgtctcctcagcctccaccaagggcccagtcggtcttccccctcggcgccctgcctccacggagaccaccgtcccgaggacgccaacacggccggccccgtcggggccg

SEQ ID NO: 532754 - DNA, 537 bp, Homo sapiens
  misc_feature: HEFZJCU01EI0O7.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtatactgtgtgggggcatttacttgacccctgggggccggggaacccgtggtcaccggtctacccccacccctccaacccg

SEQ ID NO: 532755 - DNA, 522 bp, Homo sapiens
  misc_feature: HEFZJCU01C05NZ.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatgaactgaggaatctgacatctgacgacacggccatatattactgtgcgagaaggacggttttggggcgcggactcctcttgagatctggggccaggggacaagtggtcaccgtcctcttcagt

SEQ ID NO: 532756 - DNA, 487 bp, Homo sapiens; identical to SEQ ID NO: 447190
  misc_feature: HEFZJCU01C2EKP.3.48.E04.1.454.heavy.3.raw

SEQ ID NO: 532757 - DNA, 521 bp, Homo sapiens
  misc_feature: HEFZJCU01BY5BE.53.58.F03.1.454.heavy.3.raw
cgcgtatacacacgaccggtgctcgatttagtctgatcgagaagggaaaggggatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggagaccctgtccctcacctgcactgtctctgttggctccatcattcattatttctggagctgggtccggcagcccccagggaagggactggagtggattgggtatgtctattacaccgggaccacccactacaaccccctccctcaagagtcgagtcaccatatcagtagacacgtccaggaaccagttctccctgaagctgagctctgcgaccgctgcgacacggccgtgtattattgtgcgagagttagatttgatactggtgcagccggtacgggggtcctggttccgacccgtggggccatggaacctggtcaccgtctcctcag

SEQ ID NO: 532758 - DNA, 501 bp, Homo sapiens
  misc_feature: HEFZJCU01EC03R.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcaagagtcacgattaccgcggacgaatccacgagcacagtctatatgggaattgaccagcctgacatcagaggacacggccgtctatttttgtgtcgacagaaagagattccatactcaggcgggggcactatggcagcagctgatacgt

SEQ ID NO: 532759 - DNA, 534 bp, Homo sapiens
  misc_feature: HEFZJCU01E1VOF.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctggggcccgggaaccctcggtcaccgtctcctcagcctccaccaagggcccatcggtcttcccccttcggcaccctcctcc

SEQ ID NO: 532760 - DNA, 511 bp, Homo sapiens
  misc_feature: HEFZJCU01B0WFM.51.81.H04.1.454.heavy.3.raw
  modified_base (440)..(440): a, c, t, g, unknown or other
cgatcgtatacacgaccggtgctcgatttagtagtgtagattcgcggggggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggggcgtggtccaggctgggaggtccctgagactctcctgtgcagcctctggattcaccttcagtacccatgaaatgcactgggtccgccaggctccaggcaaggggctggagtgggtgcagttatatcctatgatggaagcaataagcactacgcagagtccgtgaagggccgattgaccatctccagagacaactcgaagaatacggttcttctacaaatgaacagcctagngagctgaggacaccggctattgttttactggttgcgagagggaactcgattacagtcagccctgaagaaca

SEQ ID NO: 532761 - DNA, 527 bp, Homo sapiens
  misc_feature: HEFZJCU01ETPMK.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgaccctggggccggggaacctggtcacgtctccccaccctccaccaac

SEQ ID NO: 532762 - DNA, 517 bp, Homo sapiens
  misc_feature: HEFZJCU01A5X9W.49.12.B01.1.454.heavy.3.raw
agtcgagagacacgaccggtgctcgatttagtagtgtagattccgcgggcacgaccggtgctcgatttagtagtgtagatttgggtttggggacacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggccccctggacaagggcccttgagtgggtgggaaggagtcacccctatcccttaatatagcaaactatgcacagacattccacgacagagtcaccccttatcgcggacaaatccacgaacacagcctacatggaaactgcgcacgcctaggatctgccgacacggccgtatatttctgtgcgagagagatgttt

SEQ ID NO: 532763 - DNA, 501 bp, Homo sapiens
  misc_feature: HEFZJCU01CT252.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatgtgacttctattcagactccgtgaagggccgattcaccgtcgtcccagaggacaattccaggcacacgctgtatctgcaaatgaacagcctgagagctgaggacacggctgtgtattactgtgcgaagatttctatagaggtgacgtacggggggcgttcg

SEQ ID NO: 532764 - DNA, 523 bp, Homo sapiens
  misc_feature: HEFZJCU01AJ7VX.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatcctccagagaccattccaaagaacaccctatatcttcaaatgaacaacctgagagtcgaagacacggccgtatattactgtgcgagacatgacttcggtgaccccgtggggccagggaaccctggtccaccgtcctcctca

SEQ ID NO: 532765 - DNA, 500 bp, Homo sapiens
  misc_feature: HEFZJCU01AFUNN.11.27.C05.1.454.heavy.3.raw
  modified_base (480)..(480): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagaccgaggacacggctgtgtattactgtgcgagaggngcttatatctggaacccgat

SEQ ID NO: 532766 - DNA, 536 bp, Homo sapiens
  misc_feature: HEFZJCU01DQNAK.7.70.G04.1.454.heavy.3.raw
  modified_base (508)..(508): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccgggggaaggcctggagtggattggatacattctattactttgggagcacctactacaacccgtccctcaagagtcgagtaacgatctcagtggacacgtctaacaatcacctctccctgaggctgagctctgtgacagccgcggacacggggcgtttattacttgtgcgaggagggacggactacggtgacgtactgggggttcgaccccgtggggccaaggggaacccnggtcaccgtctcctcacgcctccaaccg

SEQ ID NO: 532767 - DNA, 472 bp, Homo sapiens
  misc_feature: HEFZJCU01DYDOH.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgccagctgacctctgtgactcccgaggacacgggtgtatattactgtggaaga

SEQ ID NO: 532768 - DNA, 524 bp, Homo sapiens
  misc_feature: HEFZJCU01DB7AR.46.67.G01.1.454.heavy.3.raw
  modified_base (459)..(459): a, c, t, g, unknown or other
  modified_base (512)..(512): a, c, t, g, unknown or other
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctccccactaccagtgcggccctccaggacgtcgagccctcatatccatagacacgtccaagaaccagtttccctgtacgctgacgtctgtgaccgccgccagacacggctgtctattattgtgcgagactagccttcngtagtggggtacttgctaaccgggatactactccacctttcggcttcggaacntctcggggctac

SEQ ID NO: 532769 - DNA, 486 bp, Homo sapiens
  misc_feature: HEFZJCU01DYZXH.48.38.D05.1.454.heavy.3.raw
agtatacatacacgaccggtgctcgatttagtatctgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagacgataatcgcgtgaataaagat

SEQ ID NO: 532770 - DNA, 492 bp, Homo sapiens
  misc_feature: HEFZJCU01CY6HH.13.71.G05.1.454.heavy.3.raw
  modified_base (465)..(465): a, c, t, g, unknown or other
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcganaacatgatgtttggagtggatgtgtta

SEQ ID NO: 532771 - DNA, 526 bp, Homo sapiens
  misc_feature: HEFZJCU01BPJUD.48.41.D08.1.454.heavy.3.raw
agtatacatacacgaccggtgctcgatttagtcacgcgagaaagggaaaggggctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcgaggtattagttggaatagtgatagcataggctatgcggactctgtgaagggccgattcaccatctccagagacaacgccaagaactccctgtatctgcaaatgaacagtctgagaactgaggacacggcctttgtattactgtagtaaaagatatgtagtttttgggggttcggggtaggttggaggtcggtc

SEQ ID NO: 532772 - DNA, 527 bp, Homo sapiens
  misc_feature: HEFZJCU01B05QC.53.78.H01.1.454.heavy.3.raw
cgcgtatacacacgaccggtgctcgatttagtgtgagtagtttgggtttgggggagcatcacataacaaccagattcctcctctaaagaagcccctgggagcacagctcatcaccatggactggacctggaggttcctctttgtggtggcagcagttacaggtgtccagtcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccccgtatttttcgatgtaagcagactctgcacagagttccagggcagattaacgattacggcggacaagtccacgactaccgcctacatggagctgaccagtctgaaatctgaggacacggccctttattactgtgcgagatataccggtggggttacggcggagatatcgccatactacttcgactactgggccgaac

SEQ ID NO: 532773 - DNA, 525 bp, Homo sapiens
  misc_feature: HEFZJCU01D63BD.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctgggagtgggtggccaacatagagtacgatggaagtgagaaaaactatgtggactccgtgaagggccgattcaccatctccagagacaacgacaagaatttagtgtatctgcaaatgaagcagcctgagagccggaggacacggctgtagtattattgtgcgag

SEQ ID NO: 532774 - DNA, 514 bp, Homo sapiens
  misc_feature: HEFZJCU01D0RJP.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggataggcgaatcaatcatagtggagacaccgactacaacccgtccctcatgagtcgagtcaccatgtcagtggactcgtccaagagtgagttctccctgaggctgacgtctttaagtgtcgctgatacggtgtctatttctgtgcgagactgcccgtctcgcacctcgtgtggccccaatttggtttaccggctacacaaaatcaggctaagtcctacgtacggtcgtggtacgtcg

SEQ ID NO: 532775 - DNA, 493 bp, Homo sapiens
  misc_feature: HEFZJCU01CL61O.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtgcgtttattcgaagcgatgggactcatgaacaatatgcagactccgtgaaggccgattcatcatctccagagacaactccaacaacacactggatctccaaatgaacagcctgagagtcgaggaacacggacccgtatatttatttgtggtccccttgtattacta

SEQ ID NO: 532776 - DNA, 429 bp, Homo sapiens; identical to SEQ ID NO: 453748
  misc_feature: HEFZJCU01C4JE4.40.34.D01.1.454.heavy.3.raw

SEQ ID NO: 532777 - DNA, 481 bp, Homo sapiens
  misc_feature: HEFZJCU01B4PQZ.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttcccagacgtatca

SEQ ID NO: 532778 - DNA, 486 bp, Homo sapiens
  misc_feature: HEFZJCU01D1S8I.49.33.C11.1.454.heavy.3.raw
agtcgagagacacgaccggtgctcgatttagagtgagctcgttgggtttgggggctctgggagaggagcccagcactagaagtcagcggtgcttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcttgtgcagcctctggattcaccttcagggtctatgacatgcactgggtccgccaggctccaggcaaggggctggagtggggtggcagttatattcatatgatggaagcaagatatactatgtagactccgtgaagggccgattcatcatctccagagacaactccgagaacacgctgtatctgcaaatgaacgaggctgagagctagaagacgacggctgtatactttactgtgacg

SEQ ID NO: 532779 - DNA, 520 bp, Homo sapiens
  misc_feature: HEFZJCU01A438T.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcggagagagtggggcccacgaacgttactacgctatggacgtctggggccaagggacc

SEQ ID NO: 532780 - DNA, 487 bp, Homo sapiens
  misc_feature: HEFZJCU01DUFJT.17.36.D03.1.454.heavy.3.raw
  modified_base (402)..(402): a, c, t, g, unknown or other
cgtagactagcacgaccggtgctcgatttagctgcgtcacgatctctcttgggtctcagagaggtgccttagccctggattccaaggcatttccacttggtgatcagcactgaacacagaggactcaccatggagttggggctgtgctgggttttccttgttgctattttagaaggtgtccagtgtgaggtgcacgctggtggagtctgggggaggcttggtaccgcctggggggtccctgagactctcctgtagagcctctggattcgccttcagtacctacagcatgaactgggtccgccaggttccagggaaggtctggagtgggttgcatacattagtagtagtgatagttccatatactacgcagactctgtgaagggccgattcaccatctccagngacagtgccaagaactcactgtatctgcaatgaacagccttagacgacgacgacacggctagtgtattactgtgcgagagatccg

SEQ ID NO: 532781 - DNA, 489 bp, Homo sapiens; identical to SEQ ID NO: 514716
  misc_feature: HEFZJCU01CDC6K.51.52.E08.1.454.heavy.3.raw

SEQ ID NO: 532782 - DNA, 502 bp, Homo sapiens
  misc_feature: HEFZJCU01EZRPQ.51.43.D10.1.454.heavy.3.raw
  modified_base (452)..(452): a, c, t, g, unknown or other
cgatcgtatacacgaccggtgctcgatttagactagcagtaaggggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttcngtgcgcgaggaattcgacttctggaataattactgggttggaactacctt

SEQ ID NO: 532783 - DNA, 509 bp, Homo sapiens
  misc_feature: HEFZJCU01AMCMZ.52.81.H04.1.454.heavy.3.raw
cgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctatttctgtacgaaagaatacacacaagcgtaggacgaggacgtaccg

SEQ ID NO: 532784 - DNA, 501 bp, Homo sapiens; identical to SEQ ID NO: 462165
  misc_feature: HEFZJCU01C2DR4.10.38.D05.1.454.heavy.3.raw

SEQ ID NO: 532785 - DNA, 507 bp, Homo sapiens
  misc_feature: HEFZJCU01EG2OQ.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctacgtgacgacacggccatgtattactgtggaagagacgttggtggctaccggcggggcctgaccactcgggggaccg

SEQ ID NO: 532786 - DNA, 516 bp, Homo sapiens
  misc_feature: HEFZJCU01EX0KC.53.76.G10.1.454.heavy.3.raw
cgcgtatacacacgaccggtgctcgatttagtcactcatacagggggagtctccctcactgcccagctgggatctcagggcttcattttctgtcctccaccatcatggggtcaaccgccatcctcgccctcctcctggctgttctccaaggagtctgtgccgaggtgcagctggtgcagtctggaacagaggtgaaaagccgggggagtctctgaagatctcctgtaagggttctggatacaactttaccacctactggatcgcctgggtgcgccagatgcccggaaaaggcctggagtggatgggcatcgtcaatcctagtgactctgaagccacatacagcccgtccttccaagggccaggtcaccctctcagccgacaagtccatcagcgccgccttcctgcagtggcgcggcctgggaggcctcggacaccgcccacatattactgtgcgagacttacagttttggggggagttagttcgtttgttcccttccacctgggtgtctttttgat

SEQ ID NO: 532787 - DNA, 496 bp, Homo sapiens
  misc_feature: HEFZJCU01C6071.48.70.G04.1.454.heavy.3.raw
  modified_base (494)..(494): a, c, t, g, unknown or other
agtatacatacacgaccggtgctcgatttagtgtagtgtgaagggaaaggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacaagcctgaaagccgaggacacagccgtgtattattgtaccgcagggctcggttactccgatactgactattggggccagggaaccctggtcaccgtctcctcagcctccaccaagggcccatcgtcttcccctggcgccctgctccaggagcacctccgagagcacagcggcccgtgggctgcctggtcaaggactacttcctatgtaacnct

SEQ ID NO: 532788 - DNA, 510 bp, Homo sapiens
  misc_feature: HEFZJCU01B1MV8.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagactcaatgtatctccaaatgagcagcctgacatccggaggacacggccgtgtacttactgtgcgagagttctttgggatgttgtcgttgcacc

SEQ ID NO: 532789 - DNA, 524 bp, Homo sapiens
  misc_feature: HEFZJCU01ESNUG.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggacagctagttaaaactcctaactacggtctgggacgtcgtggggccgaggggaccgtaac

SEQ ID NO: 532790 - DNA, 501 bp, Homo sapiens
  misc_feature: HEFZJCU01C6VZ8.48.71.G05.1.454.heavy.3.raw
agtatacatacacgaccggtgctcgatttagtgtcgtcgcaagagagaggggacaaccacattcctcctctaaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcgatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgcttatggaggggaagactggttcg

SEQ ID NO: 532791 - DNA, 506 bp, Homo sapiens
  misc_feature: HEFZJCU01A11WJ.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctgacgggcctgacatctgaagacacggctttatattactgtgcgcgagatggctgggcacagagggcacaactggctcgaccccgg

SEQ ID NO: 532792 - DNA, 534 bp, Homo sapiens
  misc_feature: HEFZJCU01D7YER.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaacgggcccatcggtcttccccctcggcgccctgctccaggagcacctccgagagcacagccggcccgtcgggtccg

SEQ ID NO: 532793 - DNA, 517 bp, Homo sapiens
  misc_feature: HEFZJCU01BW517.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaagacagagtcacaattaccgcggacgaatccacgaccacagcctacatagagctgcgcagcctgagatctgaagacacggccatttattactgtgcgagagatgcaggggccctcccgacatcgggtttattttcttttgaccttccgttgggggcccaggggaaaccccttgggtacctaccgttcctcccttccg

SEQ ID NO: 532794 - DNA, 520 bp, Homo sapiens
  misc_feature: HEFZJCU01BV0OR.51.26.C04.1.454.heavy.3.raw
  modified_base (385)..(385): a, c, t, g, unknown or other
cgatcgtatacacgaccggtgctcgatttagtctagcgactttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccntctccagagacaattccgggaacacactgtctctgcaaatgaacagcctgagagctgaggacagggctgtttattactggtgtgcgtatccggacctcactgggtacggggagtttacttcctccgacaaccggt

SEQ ID NO: 532795 - DNA, 519 bp, Homo sapiens
  misc_feature: HEFZJCU01B17Q4.48.26.C04.1.454.heavy.3.raw
agtatacatacacgaccggtgctcgatttagtctagcgactttgggtttggggctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagaggtaaggtttactagtggttcggggagtctccgacccagcaacgttggttccgaccccgttcggggaccgacgggaacccgtgggtcctaccggt

SEQ ID NO: 532796 - DNA, 502 bp, Homo sapiens
  misc_feature: HEFZJCU01D0URY.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcaggggcagggtcaccatgaccgagggagacgtccgtcaggacagcctaatatgggaggtgaccagcctgagccctgacgacacggccatatattttctgtgcgcgaggaatttcgacttctggaataattacttgggtggaact

SEQ ID NO: 532797 - DNA, 518 bp, Homo sapiens
  misc_feature: HEFZJCU01B8Z23.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccggtgacgcctaacgggccaggcggccttttgactttcgtgggggccaggggacg

SEQ ID NO: 532798 - DNA, 507 bp, Homo sapiens
  misc_feature: HEFZJCU01CLT9J.2.33.C11.1.454.heavy.3.raw
acgctcgacacacgaccggtgctcgatttagagtgagctcgttgggtttgggagccccagccttgggattcccaagtgttttcattcagtgatcaggactgaacacagaggactcaccatggactttgggctgaggtggatttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcg

SEQ ID NO: 532799 - DNA, 563 bp, Homo sapiens
  misc_feature: HEFZJCU01EB2RH.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatgaccctgtggacacagccaccatatttctgtgcacactctataggagcacctggtagtctcgccaaactggttccgaccccgtggggcccgggaaccccgtgggtccaccgtcctcctccacgtccctcccaccgtaaacggggccccaactccgggtcctttccccccgttc

SEQ ID NO: 532800 - DNA, 505 bp, Homo sapiens
  misc_feature: HEFZJCU01DB82T.9.76.G10.1.454.heavy.3.raw
  modified_base (428)..(428): a, c, t, g, unknown or other
tgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcaggggactggagtgggtggcacttatatcatatgatggaattaaaaaatactaatgcagactccgtgaagggccgattcaccatctccagagacaactccaagaacacgctgtttctgcaaatgaanagcctgagagctgaggacacggctgtgtatttctgttgctcaagataaggtgggacttcggattctttggagtgggt

SEQ ID NO: 532801 - DNA, 520 bp, Homo sapiens
  misc_feature: HEFZJCU01EGDL7.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaacgggcccatcggtcttcccctggccaccctcctccaagagcacctctgggggcacagcggccctgggctgcctggtcaaggactacttccagacgtatca

SEQ ID NO: 532802 - DNA, 501 bp, Homo sapiens
  misc_feature: HEFZJCU01DQGMD.40.81.H04.1.454.heavy.3.raw
  modified_base (451)..(451): a, c, t, g, unknown or other
tctagcgactcacgaccggtgctcgatttagtagtgtagattcgcgggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcggtccatcagcacagtctacatggatctgagcggactggacctacgtgacgacaacggccangtattactgtggaagagacgttggtggtcgtaccgcggggctgaccactc

SEQ ID NO: 532803 - DNA, 528 bp, Homo sapiens
  misc_feature: HEFZJCU01C6Y5A.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactccctgaaagcgtacactactactactacgtatggacctcgt

SEQ ID NO: 532804 - DNA, 515 bp, Homo sapiens
  misc_feature: HEFZJCU01A45F4.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctgattcatctctacaaactattggatgagctgggtccgtcaggctccagggaaggggctgggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtcggggcccgggagcccctggtccg

SEQ ID NO: 532805 - DNA, 523 bp, Homo sapiens
  misc_feature: HEFZJCU01EKFC9.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacggcttctacttctgtgcgaggagtaatactatacactgctcttttacacctccttcgacttctggggccatggaacccgtccg

SEQ ID NO: 532806 - DNA, 517 bp, Homo sapiens
  misc_feature: HEFZJCU01EHVD7.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcacgcctccaccaaggcccatcc

SEQ ID NO: 532807 - DNA, 493 bp, Homo sapiens
  misc_feature: HEFZJCU01BQV9D.49.82.H05.1.454.heavy.3.raw
agtcgagagacacgaccggtgctcgatttagtcgagctctctcgcggggagctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtcttattactgtgcgagagactcccaacagc

SEQ ID NO: 532808 - DNA, 541 bp, Homo sapiens
  misc_feature: HEFZJCU01ALAE7.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaagtggctgtgtttagttaggggccagggagcccgtggtcctaccg

SEQ ID NO: 532809 - DNA, 510 bp, Homo sapiens
  misc_feature: HEFZJCU01ED2GM.2.16.B05.1.454.heavy.3.raw
  modified_base (423)..(423): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgagggcgattcacatctccagagacaacgccaagactcactgtatntgcaatgaacagacctaagacccgaggacacggctagtgtattactggtgcgagagaccgctacgtgggggcccggggagccctggt

SEQ ID NO: 532810 - DNA, 470 bp, Homo sapiens
  misc_feature: HEFZJCU01BXJ20.4.10.A10.1.454.heavy.3.raw
agcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaaggacacggcctgtgtatttctgtgggaggtctccggtggtgctgagaaacggcgttgacttctggggccagggaaccctggtcaccgtctcctcagcctccaccaagggcccatcggtcttcccctggcgccctgctccaggagcacctccgagagcacagccggccctgggctgcctggtcaaggactacttccctacagtgct

SEQ ID NO: 532811 - DNA, 496 bp, Homo sapiens
  misc_feature: HEFZJCU01CBM98.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcacgtacatattattctgactccgtgaagggccggttcaccctctccagagacacttccaacaacatcttgtatcttcacatgcacaatctgagagtcgacgaacacggccacctacttattgtgtcgcgacatgactacgctcaattc

SEQ ID NO: 532812 - DNA, 498 bp, Homo sapiens
  misc_feature: HEFZJCU01CY193.13.33.C11.1.454.heavy.3.raw
  modified_base (471)..(471): a, c, t, g, unknown or other
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttatattgtgcaataagaattgnaaacgatgtctttgatatgtgggaccg

SEQ ID NO: 532813 - DNA, 523 bp, Homo sapiens
  misc_feature: HEFZJCU01CXQHI.16.86.H09.1.454.heavy.3.raw
  modified_base (500)..(500): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacgggccgtgtattactgtgcgagagacccctcgatagcagtggctggtccacttaggtttgacttacgtggggccagggganctttggcaccgtctcctcagcct

SEQ ID NO: 532814 - DNA, 521 bp, Homo sapiens
  misc_feature: HEFZJCU01BWRRZ.48.28.C06.1.454.heavy.3.raw
  modified_base (271)..(271): a, c, t, g, unknown or other
agtatacatacacgaccggtgctcgatttagagctcacgtattgggtttggggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttnacccccacctttcgtatgcactttgtccgccaggctccaggcaaggggctggagtggggtggctgttgtgtcaaatgatggacatgctgaatatgcagactccgtgaggggccgattcgcttctccagagacaattccaagagcacggttcatctgcaaatgagcgccctgagacctgacgacaccggctgtcttattactgtgcgagagggcgtccgagtttaacacgccggtacgggagggatattac

SEQ ID NO: 532815 - DNA, 522 bp, Homo sapiens
  misc_feature: HEFZJCU01EMLPE.12.40.D07.1.454.heavy.3.raw
  modified_base (489)..(489): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatcctgcaaatagacagcctgacgaccagacgacacggctgtctattattgcgcgagagagacacacgaacctactggccaatactatgggggcttgttctggggccgaggggaccctggtcatcgtctccccngcctccaccaaggccatcggtcttcccctggcg

SEQ ID NO: 532816 - DNA, 502 bp, Homo sapiens
  misc_feature: HEFZJCU01D9B29.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgacaatgaacagcctgagagccgaggacacggctgtgtattactgtgcgagaggagctattatctggaaccccgatgt

SEQ ID NO: 532817 - DNA, 486 bp, Homo sapiens
  misc_feature: HEFZJCU01BBSDZ.3.75.G09.1.454.heavy.3.raw
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagaggaggtttcgcgagctcgtccggcggcccagttgaacatgactatcactactac

SEQ ID NO: 532818 - DNA, 520 bp, Homo sapiens
  misc_feature: HEFZJCU01EHOHZ.10.53.E09.1.454.heavy.3.raw
catagtagtgcacgaccggtgctcgatttagagagagtgtgttgggtttggggggagacgagcccagcactggaagtcgccggtgtttccattcgttgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaattgaagaacacgctgtttctgcaatagaacagctgagagactgaggacacggctcggtgtattactgttcgtttggttctgactcgtcgggggataccttcacgcactggggccgac

SEQ ID NO: 532819 - DNA, 532 bp, Homo sapiens
  misc_feature: HEFZJCU01C9LHE.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataccaaccttcaacctgacgacactgccgtttatttttgtacgagagcgtcgtctgtcagtggaattgactactggggccagggaaccctggtcaccgtctcctcagcctccaccaaggg

SEQ ID NO: 532820 - DNA, 527 bp, Homo sapiens
  misc_feature: HEFZJCU01B413C.16.27.C05.1.454.heavy.3.raw
  modified_base (474)..(474): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgnggtggctgaccgctcttgactactgggggccggggacgcccggtcactcgtct

SEQ ID NO: 532821 - DNA, 515 bp, Homo sapiens
  misc_feature: HEFZJCU01BYVRN.15.67.G01.1.454.heavy.3.raw
  modified_base (507)..(507): a, c, t, g, unknown or other
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgagttcaccatctccagagacaacgccaagaattcactgtatttgcaaatgaacagcctggagaggcgagggacacggccgtgtattattgtgcgcgagatgatagtagactctacagtagnaggtggta

SEQ ID NO: 532822 - DNA, 513 bp, Homo sapiens
  misc_feature: HEFZJCU01DC02I.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttcgaggagcctgacatctgacgacacggccgtctattactgtgcgaggagtcccacggatccgggtgacgcctacggcagccggccttttgacctttcgtc

SEQ ID NO: 532823 - DNA, 529 bp, Homo sapiens
  misc_feature: HEFZJCU01BEQJD.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccgagggaaccctggtccaccgtctcctcagcctccacc

SEQ ID NO: 532824 - DNA, 523 bp, Homo sapiens
  misc_feature: HEFZJCU01EP0G4.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctatttttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagaacaattccaagaacactctatttcttcaaatggacagcctgaaagacgaagacacgggcgtgtattttgtgtgaaagatacgaagtctatgataccaagtttgggaggggtcctttcat

SEQ ID NO: 532825 - DNA, 536 bp, Homo sapiens
  misc_feature: HEFZJCU01B7OUC.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtacaactactactactacgtatggacctctggggaccg

SEQ ID NO: 532826 - DNA, 513 bp, Homo sapiens
  misc_feature: HEFZJCU01CXBDU.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtccacccatacctatttgactacgtggggaccg

SEQ ID NO: 532827 - DNA, 487 bp, Homo sapiens
  misc_feature: HEFZJCU01CFYQ4.2.33.C11.1.454.heavy.3.raw
acgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttccccctcggcgccctgctccaggagcaccctccgagagcacagcggccctgggcctgcctggtcaaggactacttcctgtcgagcgt

SEQ ID NO: 532828 - DNA, 408 bp, Homo sapiens
  misc_feature: HEFZJCU01C7H61.51.71.G05.1.454.heavy.3.raw
cgatcgtatacacgaccggtgctcgatttagtgtcgtcgcaagagagaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctggggcacagcggccctcgggctgcctggtcaaggactacttcctcgtagcact

SEQ ID NO: 532829 - DNA, 494 bp, Homo sapiens
  misc_feature: HEFZJCU01BVVOT.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctggggccgtggcaccctggtcactgtctcctcggcttccaccaagggcccatcggtcttcccctggcgcctgctccaggagcacctc

SEQ ID NO: 532830 - DNA, 499 bp, Homo sapiens
  misc_feature: HEFZJCU01DRYGP.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctggagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagagtggaggtcgatattgtta

SEQ ID NO: 532831 - DNA, 557 bp, Homo sapiens
  misc_feature: HEFZJCU01EGBG3.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccaggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagccctccaccaagggcccacgttcggtccttcccccgtcggccaacccgtcccttcccaaagagccacctcgtggggggccaacgacgccggcccgtcggggctcggcc

SEQ ID NO: 532832 - DNA, 489 bp, Homo sapiens
  misc_feature: HEFZJCU01CJY9Q.17.36.D03.1.454.heavy.3.raw
  modified_base (440)..(440): a, c, t, g, unknown or other
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctggggggaggcttggtaccgcctggggggtccctgagactctcctgtagagcctctggattcgccttcagtacctacagcatgaactgggtctgccaggttccagggaagggtctggagtgggttgcatacattagtagtagtgatagttccatatactacgcagactctgtgaagggccgattcaccatctccagagacagtgccaagaactcactgtatctgcaaatgaacngccttagagacgacgacacggctgtgtattactgtgcgagagatccgct

SEQ ID NO: 532833 - DNA, 520 bp, Homo sapiens
  misc_feature: HEFZJCU01EXTZZ.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattctgtgcgagagaaggggttttactagtgggttcgggggagtctccggacccaggcaactggttccgtaccccc

SEQ ID NO: 532834 - DNA, 518 bp, Homo sapiens
  misc_feature: HEFZJCU01A7K0D.49.81.H04.1.454.heavy.3.raw
agtcgagagacacgaccggtgctcgatttagtagtgtagattcgcgggggctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaaccttaatacacgggagacaaggggtcgacccccgtctaccg

SEQ ID NO: 532835 - DNA, 527 bp, Homo sapiens
  misc_feature: HEFZJCU01AIDZ3.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaacctggtccaccgtctcctcacgcctccacc

SEQ ID NO: 532836 - DNA, 495 bp, Homo sapiens; identical to SEQ ID NO: 460180
  misc_feature: HEFZJCU01AFXJD.14.25.C03.1.454.heavy.3.raw

SEQ ID NO: 532837 - DNA, 402 bp, Homo sapiens
  misc_feature: HEFZJCU01A339K.47.24.C02.1.454.heavy.3.raw
agctcacgtacacgaccggtgctcgatttagtacagatcgttagggaaagggactggagtggattggctatgttcattccagtgggagcaccgactataacctcttccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctcggcgccctgctccaggagcacctcccgagagcacagcggccctgggctgcctggtcaggactacttcctacgtgagct

SEQ ID NO: 532838 - DNA, 497 bp, Homo sapiens
  misc_feature: HEFZJCU01EGNHT.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattacgtgtgggagaggatggaggtcgatagttgtta

SEQ ID NO: 532839 - DNA, 523 bp, Homo sapiens
  misc_feature: HEFZJCU01D4UBS.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgcaggctccagggaagggctggagtgggtttcatacatttatcctagtggtgataccatatactacgcagactctgtgaagggccgattcaccatctccagggacacgaccaagaactcactgactttgcaatgaacacctgcgagccgagacacggccgtatattactgtgcgagtaacgtaaccccgttcgccgttggttactttacc

SEQ ID NO: 532840 - DNA, 512 bp, Homo sapiens
  misc_feature: HEFZJCU01A1FQY.49.65.F10.1.454.heavy.3.raw
agtcgagagacacgaccggtgctcgatttagctacgctctaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcagttatctcagatgatggaagtaaaaagtactattcggactccttgaagggccgattcaccatctccagagacaattccaagaacaccttgcatctacaaatgcacagtctgagacctgaggacacggctgtgtattactgtgcgaaggggggaggggatttttgcattggacccactttgactactc

SEQ ID NO: 532841 - DNA, 535 bp, Homo sapiens
  misc_feature: HEFZJCU01DQ44Z.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggcatactatgggggcttgttctggggccgaggggaccctgggtcatcggtcctccccacgcctacccaccaacgggcccatcggtcttccccctggccgccgtcg

SEQ ID NO: 532842 - DNA, 396 bp, Homo sapiens; identical to SEQ ID NO: 444433
  misc_feature: HEFZJCU01CXWHK.47.59.F04.1.454.heavy.3.raw

SEQ ID NO: 532843 - DNA, 541 bp, Homo sapiens
  misc_feature: HEFZJCU01BLI4B.17.28.C06.1.454.heavy.3.raw
  modified_base (372)..(372): a, c, t, g, unknown or other
  modified_base (533)..(533): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagacctccagggaaggggctggagtgggtggccaacataaagcaagatggaactgccgagttttacgnggactctgtgaagggccgtttcaccatcctccagagacaacgccaagaattcactgtatctacaactgaacagcctgagagtcgcagacacggccgtgtattactgtagcgagatggtaggaaaaagtatggtctggtgtttagttgggggccaggggacncccgtggt

SEQ ID NO: 532844 - DNA, 504 bp, Homo sapiens
  misc_feature: HEFZJCU01EIBBZ.17.10.A10.1.454.heavy.3.raw
  modified_base (461)..(461): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacaccccccacgaacacagtctacatgcaactgacgagcctgagagctgacgacacggccgtctattactgtgcgagaatgttttcngtcatcgtacaatttgataggtctctatggactggacttcgtc

SEQ ID NO: 532845 - DNA, 545 bp, Homo sapiens
  misc_feature: HEFZJCU01A1FD7.16.27.C05.1.454.heavy.3.raw
tgtactactccacgaccggtgctcgatttagacgcgatcgaagggtttgggggggaggaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggttccgccaggctccaggcaaggggctgaagtgggtggcgtttatttcatatgatggaactactcaacactatccagactccgggggagggccgattcaccgtctccagagacaattccaagaacagggtgtttctccaagtgattgatctgagaagtgaggacacggctgtttattactgtgcgcggtggctggtaccgcttcctttgactacgtacgggggccgggggacggccccggtcgatcggtctccc

SEQ ID NO: 532846 - DNA, 499 bp, Homo sapiens
  misc_feature: HEFZJCU01BG6UE.48.34.D01.1.454.heavy.3.raw
agtatacatacacgaccggtgctcgatttagatcgtctgtgttgggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccaggggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 532847 - DNA, 550 bp, Homo sapiens
  misc_feature: HEFZJCU01BHI5X.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgacaaatgaacagcctagaagaccgaggacacagccatttactatttgtaaccaaatgaaatacgtggggggaacggggggtaaaagttgggggccaagggaaccctggtcgtccgtctcgtcag

SEQ ID NO: 532848 - DNA, 492 bp, Homo sapiens
  misc_feature: HEFZJCU01CUQFX.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgagttcaccatctccagagacaattcccagaacacggtctatctgcacctgaccagcctgagaactgacgacacgtctctctactactgtgcgagagagttgacgagt

SEQ ID NO: 532849 - DNA, 519 bp, Homo sapiens
  misc_feature: HEFZJCU01AI88B.10.34.D01.1.454.heavy.3.raw
catagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaatcaaagctgatggtgggacaacagagcacgctgcacccgtgaaaggcagattcagcatctcaagagatgattacaaaagtacgctgtatctgaacatgaacagcctgaaaacggaggacacagccgtgtacttactcgtgccacctcacggaaccggaacttattgtttcgtcgtagtc

SEQ ID NO: 532850 - DNA, 513 bp, Homo sapiens
  misc_feature: HEFZJCU01BN01V.51.12.B01.1.454.heavy.3.raw
cgatcgtatacacgaccggtgctcgatttagtagtgtagattccggggggggcatcacccagcaaccacatctgtcctctagagaaccccctgagagccccgctcctcaccatggactggacctggaggatcctcttcttggtggcagcagccacaagagcccactcccaggtgcaggtggtgcagtctgggggctgaggtgaagaagcccggggcctcagtgaaggtctcctgcaagacctctggctacacctttcagtggcaacaacgtccactgggtgcgccaggcccctggacaagggcttgagtggatgggatggtttagtctgagaactggtgccgcaaattatgcacaggagtttcggggcgagggtcatcatgaccggggacacgtccatcgccacaacttacatggaactgaccagtctgacatttgacgacacggccgtctattactgtgcgacagaagcggcggacagaggttcgcttactggttcgaggctcctccccgag

SEQ ID NO: 532851 - DNA, 530 bp, Homo sapiens
  misc_feature: HEFZJCU01EP0XC.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagctaagtcctgaggacacgggtgtattactactagtacgaaggaggggggaaccaggcgggagttccaagttaccgtcctttagtaccgtcgtcggggccgtaac

SEQ ID NO: 532852 - DNA, 498 bp, Homo sapiens
  misc_feature: HEFZJCU01BFJSA.19.59.F04.1.454.heavy.3.raw
tactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatcctccagagacagcgccaagaactcactgtatctgcaaatgaacagcctgagagccggaggaccgacggctagtttattactgtgcgagagaggtggc

SEQ ID NO: 532853 - DNA, 483 bp, Homo sapiens
  misc_feature: HEFZJCU01ELKKV.8.71.G05.1.454.heavy.3.raw
  modified_base (468)..(468): a, c, t, g, unknown or other
  modified_base (479)..(479): a, c, t, g, unknown or other
ctcgcgtgtccacgaccggtgctcgatttagtgtcgtcgcaagagagagggggcagagcctgctgaattctggctgaccagggcagtcaccagagctccagacaatgtctgtctccttcctcatcttcctgcccgtgctgggcctcccatggggtgtcctgtcacaggtacgactgcagcagtcaggtccaggactggtgaagccctcgcagaccctctcactcacctgtgtcatctccggggacagtgtctctaggcacggtagtacttggaattggatcaggcagtccccatcgagaggccttgagtggctgggaaggacattctacacgtccaaattgtataatgaatatgcagagtctgtgaagagtcgaataatcatcagcccagacacatcgaagaaccagttctccctggaactgacctctgtgactcccgaagacacggctgtttattactgtgcaaganattcagtttcnccgt

SEQ ID NO: 532854 - DNA, 315 bp, Homo sapiens; identical to SEQ ID NO: 444422
  misc_feature: HEFZJCU01A45KU.47.84.H07.1.454.heavy.3.raw

SEQ ID NO: 532855 - DNA, 516 bp, Homo sapiens
  misc_feature: HEFZJCU01EUFKV.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctgggggcacagcggcctggctgcctggtcaaggactacttcctagagacacg

SEQ ID NO: 532856 - DNA, 551 bp, Homo sapiens
  misc_feature: HEFZJCU01B5KYB.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggggtagtttattagttcccttactttgtactacgttgggggtaccgaggggaaacgtcgttgggtctaccgtcctcccgaccaggccctcccaacccaacggggccccagttccc

SEQ ID NO: 532857 - DNA, 510 bp, Homo sapiens
  misc_feature: HEFZJCU01DB97A.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcacttttatctgcaaatgaacagcctgaagaaccgacgacacggccgtctattattgtgtcatagacctaggatacaacggac

SEQ ID NO: 532858 - DNA, 523 bp, Homo sapiens
  misc_feature: HEFZJCU01DGPK5.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaaataaatatgtcatatctacaaatggatagcctagaaaatcgaggatacaggtgtttattacttgttccacgagggaatgcggttctcgtggggccgagggact

SEQ ID NO: 532859 - DNA, 496 bp, Homo sapiens
  misc_feature: HEFZJCU01C8T31.14.25.C03.1.454.heavy.3.raw
  modified_base (476)..(476): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctcagagacattccaagaacacgcagtatctgcaaatgaacagcctgagagctgaggacacggctgtgtattacgtgtgggagaggntgggaggtcgaattattgta

SEQ ID NO: 532860 - DNA, 537 bp, Homo sapiens
  misc_feature: HEFZJCU01ECYMK.10.35.D02.1.454.heavy.3.raw
catagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagacaccgtgtatctaggaaatgagcagccgtgaaagcgatgacacaggactctatttattggtaaccacttaagagtcccaacgaagaccgtggttgggggaaagggcctggccgttc

SEQ ID NO: 532861 - DNA, 520 bp, Homo sapiens
  misc_feature: HEFZJCU01AZHVJ.40.20.B09.1.454.heavy.3.raw
tctagcgactcacgaccggtgctcgatttagtgtagtgtgaaggggagctctgagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaagggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaagagggtactttgggagtactactacggtatggacgttcg

SEQ ID NO: 532862 - DNA, 516 bp, Homo sapiens
  misc_feature: HEFZJCU01DU2RT.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactacgtggggcctgggtaactgtggtctaccgtct

SEQ ID NO: 532863 - DNA, 517 bp, Homo sapiens
  misc_feature: HEFZJCU01EJ5HG.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaaatttcgagaacacattgaatctacagatgaacagtctgagagccgaggacacggctgtctattattgtgcgagagtaagtggtcatggtcctttttgaccagtggggccagggaaccctgggtcaccgtctcctcagcttccaccaagggcccatcggtcttcccctggcgccctgctccagagcacctctgggggcacagcggcccg

SEQ ID NO: 532864 - DNA, 506 bp, Homo sapiens
  misc_feature: HEFZJCU01BOV9L.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaatgacaaacgatgcttttgatatgtggggccgaagggactaacg

SEQ ID NO: 532865 - DNA, 526 bp, Homo sapiens
  misc_feature: HEFZJCU01BA9TV.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggtttccttcgacagttatggtatggacgtcgtgggggcctagggactacggtcaccgtctcctcagcctccaccgaacgggccctatcggtcctttcccccgtggccgta

SEQ ID NO: 532866 - DNA, 537 bp, Homo sapiens
  misc_feature: HEFZJCU01BV3M2.21.78.H01.1.454.heavy.3.raw
tcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtacttatgtgtggggctatttacttgaccccgtgggggcccggggtaacctgggtccaccgtctccccaccctccaccaac

SEQ ID NO: 532867 - DNA, 532 bp, Homo sapiens
  misc_feature: HEFZJCU01ECQ4B.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgagctgagctctgtgacagccgcggacacggggcgtttattactgtgcgagaggggacggactacggtgactacgtgggggttcgaccccgtggggcccaggggaaccctggtccaccgtctcctcagcctcaaccg

SEQ ID NO: 532868 - DNA, 520 bp, Homo sapiens
  misc_feature: HEFZJCU01BE7XW.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtccttcccctcggccgccctgctccaggagcacctccgagagcacagcggccctcgggctcg

SEQ ID NO: 532869 - DNA, 508 bp, Homo sapiens
  misc_feature: HEFZJCU01AGGV4.51.59.F04.1.454.heavy.3.raw
  modified_base (352)..(352): a, c, t, g, unknown or other
cgatcgtatacacgaccggtgctcgatttagtacacacacttagggattggggtgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaancaataagcactacgcagagtccgtgaagggccgattgaccatctccagagacaactcgaagaatacggttcttctacaatgaacagcctgagagctgaggacacggctatgtttactgtgcgagagggaactcgattacagcacgccctcgaaacg

SEQ ID NO: 532870 - DNA, 510 bp, Homo sapiens
  misc_feature: HEFZJCU01CQQPJ.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcggcatctccagagacaacggcaagagtatactgtatctggaatgaacaatctgagagtcgacgatacggctgtctatcattgtgttttcgatgtccttcggtccgcgggacttcgtggggccagggaccct

SEQ ID NO: 532871 - DNA, 503 bp, Homo sapiens
  misc_feature: HEFZJCU01D0ZHG.48.37.D04.1.454.heavy.3.raw
  modified_base (420)..(420): a, c, t, g, unknown or other
agtatacatacacgaccggtgctcgatttagtagcatactgttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccggggggtccctgagactctcctgtgtagcctccggattcacatttagttcccatagtatggtctgggtcccgccaggctccagggaagggtctagagtggatttcatacattaggagtggcagtagtcccatatactacgcagactctgtgaaggccgattcatcatctccagagacaatgccgagaacncactgtttctgcaaatgaacagcctgagagacgaggacacggctgtttattactgtgcgagagtgcggtatttcacctacacg

SEQ ID NO: 532872 - DNA, 526 bp, Homo sapiens
  misc_feature: HEFZJCU01EW8NA.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgtggaaaagtataggctgtgtttagttggggtccgaggggacg

SEQ ID NO: 532873 - DNA, 538 bp, Homo sapiens
  misc_feature: HEFZJCU01A0GIL.13.38.D05.1.454.heavy.3.raw
  modified_base (465)..(465): a, c, t, g, unknown or other
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcccggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactcaaaagaaatagatatatctgcaaatgaacaacctagaaaagcgaggacanaggcgtgtattactgtaccacagatgggccagatgcaaatggccgcgacgagttacgactactgggggacccc

SEQ ID NO: 532874 - DNA, 528 bp, Homo sapiens
  misc_feature: HEFZJCU01D10YU.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccaatcggtccttcccctggcaccctcctccaagagcgacctctgggggcacagcggccctgggctgcctggtcaggactacttccg

SEQ ID NO: 532875 - DNA, 520 bp, Homo sapiens
  misc_feature: HEFZJCU01C1564.10.83.H06.1.454.heavy.3.raw
catagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtctgggggaggcttggttcagccagggcggtccctgagactctcttgtacagcctctggatttaggtttcgtgattatgctatgagctggttccggcaggctccagggaaggggctggagtgggtaggtttcattagaagcatagcctatggtggggcttcagaatccgccgcgtctgtgaaagccgattcaccatctcaagagacgatcccaaaagcctcgcctacctggaaatggacagcctgaaaagcgacgacacaggcgtctattattgtgttaggagggtaccagtcgcgatagcagttcctagaggggg

SEQ ID NO: 532876 - DNA, 508 bp, Homo sapiens
  misc_feature: HEFZJCU01BLYUC.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcggggggaggcttgggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgagggccgattcaccatctccagagacaatcgccaggaattcactgtatgtggaaatgaacagtctgagagcgaggacacggctctctattactgtgcgagagaccccgaaagtac

SEQ ID NO: 532877 - DNA, 511 bp, Homo sapiens
  misc_feature: HEFZJCU01A85U9.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagtttggaggagcctgacatctgacgacacggccgtctattactgtagcgagacgtcccacgatccgggtgaagcctacggcagcggcctttgactttcgtc

SEQ ID NO: 532878 - DNA, 535 bp, Homo sapiens
  misc_feature: HEFZJCU01AFZ42.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgacagcctgagagtcgcagacacggcctggtattactgtgcgagatgtggaaaaagtaatggctgtgtttattggggcaggggagcctggtactaccg

SEQ ID NO: 532879 - DNA, 529 bp, Homo sapiens
  misc_feature: HEFZJCU01BOWLJ.40.33.C11.1.454.heavy.3.raw
tctagcgactcacgaccggtgctcgatttagagtgagctcgttgggtttgggggagccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtcttattattgtacaaagtggggactaatgaatatggtgtaggacgtcgtgggccgaaggggaccacggtcgtcgtcc

SEQ ID NO: 532880 - DNA, 480 bp, Homo sapiens
  misc_feature: HEFZJCU01D069X.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcgtcttcccctggcaccctcctccaagagcacctctgggggcacagcggccctgggctgcctggtcaggactactccgtatctctcg

SEQ ID NO: 532881 - DNA, 505 bp, Homo sapiens
  misc_feature: HEFZJCU01DMPC8.17.10.A10.1.454.heavy.3.raw
  modified_base (428)..(428): a, c, t, g, unknown or other
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacaggcccccggacaagggcttgagtgggtggggtgggtcagcggctttgacggtaaggcacagtatgcaccgaagatgaagggcagagtcacgattaccacggacacccccagaaccacagtctacatgcaactgacgagcctgagagctgaacgnacggccgtctattctgtgcgagaatgttttcngtcatcgtactaatttgataggctctagtggacttggacttcgtc

SEQ ID NO: 532882 - DNA, 515 bp, Homo sapiens
  misc_feature: HEFZJCU01BY1I7.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgttattactgtgcgagagatggggcccacgaacgttactacgctatggacgtcgtggggaccg

SEQ ID NO: 532883 - DNA, 501 bp, Homo sapiens
  misc_feature: HEFZJCU01CF4M8.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcgtttttgatgtcctttgatatgtgggcgagggacaatggtctaccgtctt

SEQ ID NO: 532884 - DNA, 501 bp, Homo sapiens
  misc_feature: HEFZJCU01BNJ3D.3.67.G01.1.454.heavy.3.raw
  modified_base (429)..(429): a, c, t, g, unknown or other
  modified_base (473)..(473): a, c, t, g, unknown or other
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccagggaaggggctggagtgggttggccatataaaaagtagactgctggtgagacaacagactacgctgctgccttcagaggcagattcaccatcttcagagatgaatcacagagcactntgtttctgcaaatgaacagcctggaagacgcggaacacagccangtattattgtacattaggacactatacg

SEQ ID NO: 532885 - DNA, 506 bp, Homo sapiens
  misc_feature: HEFZJCU01CX0B1.17.10.A10.1.454.heavy.3.raw
  modified_base (459)..(459): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggcgtctattactgtgcgagaatgttttcngttcatcgtacaagttttgataggctcttaatggactggacttcgtc

SEQ ID NO: 532886 - DNA, 493 bp, Homo sapiens
  misc_feature: HEFZJCU01CW41J.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtatttactgtgcaaggaggtatagcagctactggtacgactacgtggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 532887 - DNA, 538 bp, Homo sapiens
  misc_feature: HEFZJCU01BIMDD.48.40.D07.1.454.heavy.3.raw
agtatacatacacgaccggtgctcgatttagtgatagagcgtaacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgaggaggcgaggacaccgcgctttattattgtacacgtcgttttacttttctaatggtggctcttacgaacgacatgactattggggtcggggaaccctggt

SEQ ID NO: 532888 - DNA, 511 bp, Homo sapiens
  misc_feature: HEFZJCU01C87CL.11.27.C05.1.454.heavy.3.raw
cgagagataccacgaccggtgctcgatttagacgcgatcgaagggtttggggggagagaggagccttagccctggattccaaggcctatccacttggtgatcggcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactccaccatctccagagacaacgccaagaactcactgtatctgcaaatgaacagcctgagagccgaggaccacggctgtgtattctgtgcgagaggagctattatctacggaaccccatcgtctttt

SEQ ID NO: 532889 - DNA, 506 bp, Homo sapiens
  misc_feature: HEFZJCU01DMBQC.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccacgatccggtgagcctaaggcaggcgcctttgaccttcgtc

SEQ ID NO: 532890 - DNA, 552 bp, Homo sapiens
  misc_feature: HEFZJCU01ALDMG.17.28.C06.1.454.heavy.3.raw
  modified_base (510)..(510): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccaggggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtaattacgtgtgtcgaggtatggaaaggtaaaagtagcgtntgtttagtttaggtcggacggaggaccgccggtcgcctaccg

SEQ ID NO: 532891 - DNA, 529 bp, Homo sapiens
  misc_feature: HEFZJCU01EWSFL.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattacaaaagacacgctgtatctgcaatgaacagcctgagaaccgaggacacagccgtgtattactgtaccacactcccctagaaacgcgtcaactactactactacgtatgtaccg

SEQ ID NO: 532892 - DNA, 522 bp, Homo sapiens
  misc_feature: HEFZJCU01BGQ7P.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactacgtgggcagggaaccctggtcaccgtctcctcagcctcc

SEQ ID NO: 532893 - DNA, 530 bp, Homo sapiens
  misc_feature: HEFZJCU01CQN75.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacacctttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggactttgagcagcctgaggtctgacgacacggccatcgtattattgtgcgaggcaggacggggctaaagggcataaagtggttcgacccctggggccagggaaccctggtcaccgtctcctcagcctccacccaagggcccatcggtcttcccctggcgccctgctcacggagcacctccgagagcacagcggcccgtgggtccg

SEQ ID NO: 532894 - DNA, 507 bp, Homo sapiens
  misc_feature: HEFZJCU01DN3PL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacaatggaagttgaggagcctgacatctgacgacacggccgtctattactgtgcgagagtcccacgatccggtgagcctacggcagcggcctttggactttctc

SEQ ID NO: 532895 - DNA, 503 bp, Homo sapiens; identical to SEQ ID NO: 462172
  misc_feature: HEFZJCU01ECSFT.17.25.C03.1.454.heavy.3.raw

SEQ ID NO: 532896 - DNA, 531 bp, Homo sapiens
  misc_feature: HEFZJCU01BEIO1.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccacaacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaacccgtggtcaccgtctcctcagcctccaccaagggcccatcggtcttcccctcggcaccctcctcc

SEQ ID NO: 532897 - DNA, 507 bp, Homo sapiens
  misc_feature: HEFZJCU01DP7NN.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctggtcatcgtacaatttcgattaggcttctatggactggactttcgtc

SEQ ID NO: 532898 - DNA, 528 bp, Homo sapiens
  misc_feature: HEFZJCU01B53XO.3.70.G04.1.454.heavy.3.raw
agacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagacctccgtgcagggccgattcaccatctccagagacaatttcaagaatacgttgctcctcaatgaacaacctgagaacgaggacacggccgtatattattgtgcgagtagtacggtggtgatgtgggtgttaactggggctgggaacctggtcaccgtctcctca

SEQ ID NO: 532899 - DNA, 502 bp, Homo sapiens
  misc_feature: HEFZJCU01EJMUB.17.10.A10.1.454.heavy.3.raw
  modified_base (410)..(410): a, c, t, g, unknown or other
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcacgaagatgaagggcagagtcacgattaccacggacacccccacgaaccacagtctacatgcaactgacgancctgagagctgacgacacggccgtctattactgtagcgagaatgttttcngtcatcgtataattgataggtctctatggactggacttcgtc

SEQ ID NO: 532900 - DNA, 540 bp, Homo sapiens
  misc_feature: HEFZJCU01AHRR4.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcgaaggcagttcgtaggaaactagttagtgggttaggggggagtttggggtttttttttcgttacgttacgggatc

SEQ ID NO: 532901 - DNA, 550 bp, Homo sapiens
  misc_feature: HEFZJCU01BZYP6.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactcggccaatactatgggggtcttgttctgggggccagggggaccctggtcatcgtcctccccaggcccttacccacccaaacggggccccgtactcggtccttccccctcggccgtccctcg

SEQ ID NO: 532902 - DNA, 510 bp, Homo sapiens
  misc_feature: HEFZJCU01C134I.48.34.D01.1.454.heavy.3.raw
agtatacatacacgaccggtgctcgatttagatcgtctgtgttgggtttggggctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatacactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggat

SEQ ID NO: 532903 - DNA, 490 bp, Homo sapiens
  misc_feature: HEFZJCU01DL2DM.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttggacgacacggccgtatattactgtgcgagaatcgaagaaggtggctacaatcac

SEQ ID NO: 532904 - DNA, 512 bp, Homo sapiens; identical to SEQ ID NO: 447906
  misc_feature: HEFZJCU01CRMHE.17.33.C11.1.454.heavy.3.raw

SEQ ID NO: 532905 - DNA, 476 bp, Homo sapiens
  misc_feature: HEFZJCU01BKYV3.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctgcttcgacccctggggccagggaaccctggtcaccgtctcctcagcctccaccaagggcccatcggtcttccccctggcaccctcctccaagagcacctctggggcacagcggccctgggctgcctggtcaaggactacttccgagtagtaca

SEQ ID NO: 532906 - DNA, 508 bp, Homo sapiens
  misc_feature: HEFZJCU01C1WXR.40.10.A10.1.454.heavy.3.raw
tctagcgactcacgaccggtgctcgatttagcgtcgatctcaggggctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagatttcagccccctcccaaacgtaggaaattaatta

SEQ ID NO: 532907 - DNA, 495 bp, Homo sapiens
  misc_feature: HEFZJCU01CS4ES.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacgacggctgtgtatttactgtgggagagatggaggtcgatattgtt

SEQ ID NO: 532908 - DNA, 522 bp, Homo sapiens
  misc_feature: HEFZJCU01B45G5.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccagggggaccctggtcatcgtctccccagcctccaccaagggcccatcggtcttcccctgcg

SEQ ID NO: 532909 - DNA, 508 bp, Homo sapiens
  misc_feature: HEFZJCU01BKLKR.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtccaccctgaccacagagacatccacgaccacagtctacatggagctgtggagcctgagacctgacgacacggccctctattactgtgcgacggccctatcctacagtgaccactccacgctggttcgacctctggggccac

SEQ ID NO: 532910 - DNA, 523 bp, Homo sapiens
  misc_feature: HEFZJCU01CBOCK.3.63.F08.1.454.heavy.3.raw
  modified_base (430)..(430): a, c, t, g, unknown or other
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagggcctggtcaagcctggggggtccctgagactctcctgtgcagcctctggattcaccttcagtagctatagcatgaactgggtccgccaggctccagggaagggctggagtgggtctcatccattagtagtagtagtagttacatatactacgcagactcagtgaagggccgattcaccatctccagagacaacgccaagaactcactgtatctgacaaatnaacagcctgagagccgaggacacgggactggtgtattactgtacgcggtagttttgggttttggggccggggtataggcaggccggggtaccc

SEQ ID NO: 532911 - DNA, 503 bp, Homo sapiens; identical to SEQ ID NO: 445995
  misc_feature: HEFZJCU01CB8UX.17.25.C03.1.454.heavy.3.raw

SEQ ID NO: 532912 - DNA, 523 bp, Homo sapiens
  misc_feature: HEFZJCU01EKXW0.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggatagacttaccatgaccacgaactcctccataaacacagcctacatggagttgaggagcctgacatctgacgacacggccgtctattactgtgcgaagacgtcccacgactccgggtgacgcctacgggcaggcggcctttgactttcgtgggggcccagggggtaccg

SEQ ID NO: 532913 - DNA, 540 bp, Homo sapiens
  misc_feature: HEFZJCU01D5GYU.18.59.F04.1.454.heavy.3.raw
tacgagtatgcacgaccggtgctcgatttagtacacacacttagggattggggagctctgggagaggagccccagccttgggattcccaagtgtttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcaacgctgtatctgcaaatgaacagcctgagaaccgaggacacagccgtgtattactgtaccacactcccctgaaacgcgtacaactactaactactacggtatggacctcgg

SEQ ID NO: 532914 - DNA, 503 bp, Homo sapiens
  misc_feature: HEFZJCU01AFOBP.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggtttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggacaacaactcactgtatctaggaaatcaacagcctgagagtcgaggacacggctgtatattattgtgcgagacgcccctacggtgtaccg

SEQ ID NO: 532915 - DNA, 507 bp, Homo sapiens
  misc_feature: HEFZJCU01CL88Q.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtcgacccctcgactgactaaaccggactggttacgaccccgtcggggccgagggaacccgtggtcaccgtctcct

SEQ ID NO: 532916 - DNA, 525 bp, Homo sapiens
  misc_feature: HEFZJCU01DSE5U.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgtactactggggccgaggggaactcgtggtcaccggtctccgcacgcctcccaccaacgggcccatcc

SEQ ID NO: 532917 - DNA, 517 bp, Homo sapiens
  misc_feature: HEFZJCU01EQO3K.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgaccgacacgggccgtctattactgtgcgagacgtcccacgatcccgggtgacgtctaccgggcaggccggtcctttgacctttcgtc

SEQ ID NO: 532918 - DNA, 531 bp, Homo sapiens
  misc_feature: HEFZJCU01ENJ6F.47.46.E02.1.454.heavy.3.raw
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaagggctggagtggtctcaagtatgatgagatggtgaagcacattctacgtggactccgtgaagggccggttcgaccatctccagagaccaatttcaggagcacgctgtatctacaaatgaacagcctgagagccgaggacacggccgtatatttctgtgcgaaagtctatagcagtgccccctacgcgccactttccgtttgacctttcgtcgggggcctaac

SEQ ID NO: 532919 - DNA, 525 bp, Homo sapiens
  misc_feature: HEFZJCU01BAQK6.48.44.D11.1.454.heavy.3.raw
  modified_base (510)..(510): a, c, t, g, unknown or other
agtatacatacacgaccggtgctcgatttagcgcagtacgaagggggggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctgggggtccctgaaactctcctgtacagcctctgggttcgccttcacagcctctgggttcagctttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatgacaactagaaaccgagacacggccgtttattattgtacttctgagtgacgggacgcngctattgggcaggaa

SEQ ID NO: 532920 - DNA, 518 bp, Homo sapiens
  misc_feature: HEFZJCU01BF6I5.40.65.F10.1.454.heavy.3.raw
tctagcgactcacgaccggtgctcgatttagctacgctctaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccacgcccccaggggaaggggctggagtggattgggagtatttaccacagtgggagcacctactacaacccgtccctacaaaagtcgaggcaccatatccgtagacacgtccaagaaccaattctccctgaagctgagctctgtgaccgccgcagacacggctgtctattactgtgcgaggccccgagccgcagtggctttttgattgtcctttgtattatgtgggggccgtaagggacaagtggtacaccgtctcttccg

SEQ ID NO: 532921 - DNA, 510 bp, Homo sapiens
  misc_feature: HEFZJCU01C2OKE.11.19.B08.1.454.heavy.3.raw
  modified_base (207)..(207): a, c, t, g, unknown or other
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaancttggtacagcctggagggtccctgagactcttctgtgcagcctctggattcgactttagtagttatgaaatgaactgggtccgccaggctccagggaaggggctgggagtgggtttcattacatttctagtaattctggtaccatacactatgcagtctctgtgaagggccgattcaccatctccagagacaacgccaggaactcactttatctgcaaatgagcagcctgagagtcgaggacacgggtatttattactgtgcgagagatagtctgtctatcgcgtttccgggagtctaactt

SEQ ID NO: 532922 - DNA, 526 bp, Homo sapiens
  misc_feature: HEFZJCU01CK33Z.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtgattgactagtgggccagggaccctggtcaccgtctcctcagcctccaccaagg

SEQ ID NO: 532923 - DNA, 483 bp, Homo sapiens
  misc_feature: HEFZJCU01CHSBV.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgctactgggtgcgactggccctggacaagggcttgagtggatgggatggatcgaccctaacagctgtggcacaaagtatgcacagaagtttcagggcaggggtccaccatagaccagggacacgtccatcagcacgtccatcagcacagcctacatggacctgagccgggcctggacatcgtgacgacacggcctagtatttctgtgcga

SEQ ID NO: 532924 - DNA, 349 bp, Homo sapiens
  misc_feature: HEFZJCU01DGFE8.16.87.H10.1.454.heavy.3.raw
tgtactactccacgaccggtgctcgatttagcagtactgcgttgggtttgggggagccccagccctgggattcccagctgttctgcttgctgatcaggactgcacacagagaactcaccatggagtttgggctgatctgggtcttccttgttgacttttttaaaggtgtcctagtgtgaggagcaggctggttggagggttccggggggaggtctttagttcagccgttggggaacgtccctgagaccttctcctggtgcagcctcgtggtacttcaccttcaagcaattactggctgcacgtgggtccgacaagctccgagggaagggctggtgtgggtctcacatta

SEQ ID NO: 532925 - DNA, 539 bp, Homo sapiens
  misc_feature: HEFZJCU01EALIG.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgtgtttattggggccaggggacgccgtggtcaccg

SEQ ID NO: 532926 - DNA, 532 bp, Homo sapiens
  misc_feature: HEFZJCU01A5TI7.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcggagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctggggccaggggaccctggtcatcgtcctccccagccctccaccgaagggcccatccgggtccttcccccgtggccg

SEQ ID NO: 532927 - DNA, 492 bp, Homo sapiens
  misc_feature: HEFZJCU01A66V1.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcacccgtctcctcagcctccaccaacgggcccatcggtcttcccctggcaccctcctccaagagcacctctggggcacagcggccctggctgcctggtcaaggactacttccgtactctctcg

SEQ ID NO: 532928 - DNA, 501 bp, Homo sapiens
  misc_feature: HEFZJCU01AWRRI.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccaggggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgat

SEQ ID NO: 532929 - DNA, 504 bp, Homo sapiens
  misc_feature: HEFZJCU01DRQ7S.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggacaactcctatgtcttttgatatcgtggggaccaaggggac

SEQ ID NO: 532930 - DNA, 506 bp, Homo sapiens; identical to SEQ ID NO: 444696
  misc_feature: HEFZJCU01EQCU4.16.34.D01.1.454.heavy.3.raw

SEQ ID NO: 532931 - DNA, 521 bp, Homo sapiens
  misc_feature: HEFZJCU01DB489.40.9.A09.1.454.heavy.3.raw
tctagcgactcacgaccggtgctcgatttagcgagacgcgcaggggggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacgggctgtttattactgtgcgagagatggcactcggggcggtgactttgactacgtgggggcctagggg

SEQ ID NO: 532932 - DNA, 509 bp, Homo sapiens
  misc_feature: HEFZJCU01C2UHB.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgcaagctccaggcaagggattggagtgggtggcagttgtttcatctgagggcagtgttcaagtggtatgcagactccgtgaagggccgattcaccatctccagagacaattccaggaaccacaatgtatttggagctgaacagcctaagtcctgaggacacgggcgtatactactgtacgaaggagggggaacaggcggagtcaagtactcttgacg

SEQ ID NO: 532933 - DNA, 524 bp, Homo sapiens
  misc_feature: HEFZJCU01EZZ0J.11.25.C03.1.454.heavy.3.raw
cgagagataccacgaccggtgctcgatttagtagtgtagatttgggtttggggagaggagcccagcactgggattccgaggtgtttccattcggtgatcagacactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgagggccgattcaccatctccagagacaactctaagaacacgctgtttcttcaaatgaacagcctgagagccgatgacacggccgtgtattactgtgcgagagagtggggcccacgaacgttactacgctatggacgtcgtggggccaagggacc

SEQ ID NO: 532934 - DNA, 507 bp, Homo sapiens
  misc_feature: HEFZJCU01EIAXU.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccggaacagacttaccatgaccacgaactcctccataaacacagcctacatggagttgaggagcctgacatctgacgacacggccgtctattactgtgcgagagtcccacgatccggttgagtcctacggcagcggtcctttgactttctc

SEQ ID NO: 532935 - DNA, 485 bp, Homo sapiens
  misc_feature: HEFZJCU01DRVI4.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtggaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccaggacacgtccatcagcacgtccatcagcacagcctacatggacctgacgcggccgtggacagtctgacgacacggccgtatagtttctgtgcgagggg

SEQ ID NO: 532936 - DNA, 495 bp, Homo sapiens
  misc_feature: HEFZJCU01D156N.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcggatattgtta

SEQ ID NO: 532937 - DNA, 510 bp, Homo sapiens; identical to SEQ ID NO: 458329
  misc_feature: HEFZJCU01A2SDH.17.25.C03.1.454.heavy.3.raw

SEQ ID NO: 532938 - DNA, 511 bp, Homo sapiens
  misc_feature: HEFZJCU01BEO6S.13.59.F04.1.454.heavy.3.raw
tcacgtactacacgaccggtgctcgatttagtacacacacttagggattggggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctcacagtgacctgcaccgtctctgggctttcactcaatagaagtacagtgtgtatgagttggattcgtcagtccccagggaaggccctggagtggcttgcacgcattgattgggatgatgatcaaaaatattacaacacatctatgaagaccaggctcaccatctccaaggacatcttcacgagccaagtggtccttagaatgaccaacttggaccctgtggacacaggcaccctatttatttgttgcgacatcaaagagatttctactacggtgtggtacgtc

SEQ ID NO: 532939 - DNA, 508 bp, Homo sapiens
  misc_feature: HEFZJCU01EZU62.48.50.E06.1.454.heavy.3.raw
  modified_base (445)..(445): a, c, t, g, unknown or other
  modified_base (472)..(472): a, c, t, g, unknown or other
agtatacatacacgaccggtgctcgatttagatctactgacaacacacaagggggagagaggagccttagccctggattccaaggcccagccacttggtgatcagcactgagcaccgaggattcaccatggaactggggctccgctgggttttccttgttgctattttagaaggtgtccagtgtgaggtgcagttggtggaatctgggggaggcctggtcaagccgggggggtccctgagactctcttgtgcagcctctggattcaccttcagtagatatgtcatgatttgggtccgccaggctccagggaaggggctggagtgggtctcatccattagtagtaatagtgattacatatattatgcagaatcactgaagggccgattcaccatctccagagacaacgccaaagagtctctgtttctggacatgaccagcctgagngaccgaagacacggctacatatactgngcgaaagtttcggtctgggagtcgtggtattttggt

SEQ ID NO: 532940 - DNA, 525 bp, Homo sapiens
  misc_feature: HEFZJCU01D5XX8.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgagggccgattcaccatctccaggacgacaattccaagaaccacgctgtttcttcaaatgaacagcctgagagccgatgacacggccgtgtattactgtgcgagagagtggggcccgacgaacgttactacgctagtggacgtcgtggggccgaagggaccg

SEQ ID NO: 532941 - DNA, 543 bp, Homo sapiens
  misc_feature: HEFZJCU01AZIPY.17.28.C06.1.454.heavy.3.raw
  modified_base (431)..(431): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagacctctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatntacaactgaacagcctgagagtcgcagacacggccgtgtattactgtgcgagatgtaggaaaaagtagtaggctgtgtttattgggggccagggacgcccgtggtcctaccg

SEQ ID NO: 532942 - DNA, 512 bp, Homo sapiens
  misc_feature: HEFZJCU01CBWV2.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtcggcccctaatttggtttaccggcacacaaaatcagggcaagtcctacgacggtctac

SEQ ID NO: 532943 - DNA, 534 bp, Homo sapiens
  misc_feature: HEFZJCU01CD3NO.2.55.E11.1.454.heavy.3.raw
acgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtctgggggaggcttcgtaaatcctggggggtcccttggactctcctgtgcaggccctgaattcactctcaataatgcctacataaactgggtccgccaggctccagggaaggggctggagtgggttggccatattaaaagcaaatctgatggtgggacaatacactacgctgcacccgtgaaaggcagattcaccatctcaagagacacttcaagaaattcattgtatctgcaaatgaacagtttagaaaaccgaggaacacagccgtgtattattgtacagtctggacactattctccctggggccacggggaaccctggtcaccgtcc

SEQ ID NO: 532944 - DNA, 520 bp, Homo sapiens
  misc_feature: HEFZJCU01CYEDP.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactctactacggtctggacgtctggggccacggggaccaaac

SEQ ID NO: 532945 - DNA, 533 bp, Homo sapiens
  misc_feature: HEFZJCU01BE84M.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagacgcacctctggggcac

SEQ ID NO: 532946 - DNA, 525 bp, Homo sapiens
  misc_feature: HEFZJCU01CMSVP.53.55.E11.1.454.heavy.3.raw
  modified_base (492)..(492): a, c, t, g, unknown or other
cgcgtatacacacgaccggtgctcgatttagcactcgcacgttgggtttgggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaatacggagganaacggtaacccccgtcgccacggtacggtaccg

SEQ ID NO: 532947 - DNA, 523 bp, Homo sapiens
  misc_feature: HEFZJCU01DYUBR.52.83.H06.1.454.heavy.3.raw
  modified_base (440)..(440): a, c, t, g, unknown or other
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaagggggctggagtgggtggcatttatatcaaatgatggaagtaacaaatactatgtagactccgtgaagggccgattcaccatctccagagacaattccaagaatacgctgtatctgcacatgaacagcctganagccgaagacacgggtgtttattacttgtgcgtaacttaacttacggaggtacgaaccggtaacccccgtaccgccacggccg

SEQ ID NO: 532948 - DNA, 517 bp, Homo sapiens
  misc_feature: HEFZJCU01CVNM1.13.9.A09.1.454.heavy.3.raw
tcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctggggggaggtttggtacagccagggcggtccctgagactctcctgtataacttctggattcaacttgggtgattatgctatgaactgggtccgccaggctccagggaaggggctgggagtgggtaggtttcattaggagcaattctcatgatgggacaacagaatacgccgcgtctgtaaaaggcagattcaccatctcaagagatgagtccagaagcatcgtcctttctgcagatgagtagcctgaagaccgaggacacagccatctattactgtgctagagagtattgcagtccacgacctgcctagtgggggtccg

SEQ ID NO: 532949 - DNA, 553 bp, Homo sapiens
  misc_feature: HEFZJCU01C3QAJ.13.88.H11.1.454.heavy.3.raw
tcacgtactacacgaccggtgctcgatttagcgacagcgagaacacacaaagggggggattcccaagtgttttcattcagtgatcaggactgaacacagaggactcaccatggagtttgggctgagctggattttccttggtgtttttttaaaaggtgtccactgtgagctgcagctggtggagtctgggggggggcttggtaaagcctggggggtcccttacactctcctgtgtagcctctaaaatcactttcaacgacgcctggatgagctgggtccgccaggcgccaggggaggggactggagtgggttggccgtattaaaagcgaaggccgatggtgggacagcagacttcgctgcacccgtgcaagccagattcaccctctcaagaccatgatttagagaatactgtgtatttgcaatgaacagcttgacaaccgaggacgcaggcgtttattactgtgccagtagttccacctggccactcctactttcctttgacttcgttcggggccaggggaaaccctggttccgcccgtcgtccctcagtctt

SEQ ID NO: 532950 - DNA, 419 bp, Homo sapiens
  misc_feature: HEFZJCU01D5KOB.40.81.H04.1.454.heavy.3.raw
tctagcgactcacgaccggtgctcgatttagtagtgtagattcgcgggggagcatcacccagcaaccacatctgtcctctagagaatcccctggagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatgggggtggatcaaccctaccagaggtggcacaaagtatcgacagaactttcagggcagggtcaccatgacctggggaccgcggtccatcagcacagtctacatggat

SEQ ID NO: 532951 - DNA, 469 bp, Homo sapiens
  misc_feature: HEFZJCU01BO8N6.4.82.H05.1.454.heavy.3.raw
  modified_base (364)..(364): a, c, t, g, unknown or other
agcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagcctggggcctcagtgatggtctcctgcaaggcttctggattcaccttcaccggctactatttgcactgggtgcgacaggcccctggacaagggcttgagtggatgggatggatcaaccctaatagtggtgccacacactatgcacagtacttttcngggcaggggtcaccatgaccagggacacgtccatcagcacagccctacatggagctgagcgaggctgagatcgtgacgacgacggccgtgtattactgtgtgtct

SEQ ID NO: 532952 - DNA, 495 bp, Homo sapiens
  misc_feature: HEFZJCU01BNGMS.51.38.D05.1.454.heavy.3.raw
cgatcgtatacacgaccggtgctcgatttagtatctgatagttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaacccgtccggattcaccttcagtaactatgcaatgcactgggtccgccaggctccaggcaaggggctggactgggtggcaggcatatcatttgatggaagcaaagaagtactatgcagactccgtgaagggcgattcaccatctccagacgacagttccgatgacacagtctatctacacatgagcagtgtgagacctgacgacacggctctttttatgtgcgccaggaagcagtggctgg

SEQ ID NO: 532953 - DNA, 519 bp, Homo sapiens
  misc_feature: HEFZJCU01BY5P8.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgaattcaccatctccagagacaattccaggaacacaatgtatttggaaatgaacagcctaagtcctgaggacacgggtgtatactactgtacgaaggaggggggaaccgagcgggagtccgaagtactccttgacgtctgggccgtac

SEQ ID NO: 532954 - DNA, 497 bp, Homo sapiens
  misc_feature: HEFZJCU01DPBRH.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggtggtgactgctattgactactggggccagggaaccctgggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 532955 - DNA, 537 bp, Homo sapiens
  misc_feature: HEFZJCU01CBQVA.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttcccgcctacggtgtcacctgggtgcgacaggcccctggacaaggacttgagtggatgggatggatcgagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcgggtcttcccctggtccgccctgccttccaggtaggcacctccgacgagcacacgcggcccgtggggtcc

SEQ ID NO: 532956 - DNA, 505 bp, Homo sapiens; identical to SEQ ID NO: 447076
  misc_feature: HEFZJCU01BI237.10.38.D05.1.454.heavy.3.raw

SEQ ID NO: 532957 - DNA, 534 bp, Homo sapiens
  misc_feature: HEFZJCU01EIRXN.17.28.C06.1.454.heavy.3.raw
  modified_base (520)..(520): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtggtggccaacataagcaagatggaactgccgagtttacgtgactctgtgaagggccgtttcaccatctccagagacaacgccaagaattcactgtatctacaactgaacagcctgagagtcgcagacacggccgtgtattactgtgcgagatgtggaaaaagtatggctgtgtttagttggggccagggganccctggtctacccg

SEQ ID NO: 532958 - DNA, 488 bp, Homo sapiens; identical to SEQ ID NO: 448226
  misc_feature: HEFZJCU01B1P1V.18.70.G04.1.454.heavy.3.raw

SEQ ID NO: 532959 - DNA, 523 bp, Homo sapiens
  misc_feature: HEFZJCU01CMDQF.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctgggagtgggtctcctttattttacagcagtggtagtacatattccgcagactccgtgaggggccgattcaccatctccagagacactctaagaacacgctgtttcttcgaatgaacagcctgagagccgatgacacggccgtgtattactgtgcgagagatcggggcccacggaacgtttactacgctagtggacgtcgtgggggcc

SEQ ID NO: 532960 - DNA, 522 bp, Homo sapiens
  misc_feature: HEFZJCU01CJOIG.3.17.B06.1.454.heavy.3.raw
  modified_base (402)..(402): a, c, t, g, unknown or other
  modified_base (452)..(452): a, c, t, g, unknown or other
  modified_base (459)..(459): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatcctnaagagatgattcagagaactcaactttatctgcaaatgaacagcctgaanaaccganacacggccgtctattattgttgtacatagacctaagatacaacgacggtggtacctggtattc

SEQ ID NO: 532961 - DNA, 504 bp, Homo sapiens
  misc_feature: HEFZJCU01DL3AJ.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgccactgggtccgacaggcccctgggcaaggtcttgagtggatgggactaatcactccaatggtgatgggactgctacgcacagaagtttcagggcagagtcaccatgaccagggacacgtccacgagaacagactatttggagttgagcagcctgagatctgacgacacggccgtttattactgtgcgcgagagtaatagtcaccgaaactgggaaacggcggtttttggggggt

SEQ ID NO: 532962 - DNA, 516 bp, Homo sapiens
  misc_feature: HEFZJCU01E0G27.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatgtatgcagactccgtgaagggccgattcaccatctccagagacaattccaggaacacaatgtatttggagctgaacagcctaagtcctgaggacacgggcgtatactactgtacgaagggaggggggaaccgaggcgggagttaccaagtactcttgtacg

SEQ ID NO: 532963 - DNA, 552 bp, Homo sapiens
  misc_feature: HEFZJCU01D0EDL.16.28.C06.1.454.heavy.3.raw
tgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtggggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaaagggtactaactttgactactggggccagggaaccctggtcaccgtctcctcagcctccaccaagggcccatcggtcttcccctggcgccctgctccagacgcacctccgagaacacagccggcc

SEQ ID NO: 532964 - DNA, 522 bp, Homo sapiens
  misc_feature: HEFZJCU01AO89Y.14.57.F02.1.454.heavy.3.raw
  modified_base (473)..(473): a, c, t, g, unknown or other
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctgggagtgggtctcgagcaatcagtggttctagtggaagtacattcgacgccgtctccgtgaagggccggttctccatctccagagacaattccaagaacactctatttcttcaaatggacagcctgaaagacgaagacacgggcgtgtattttntgtgaaagatacgaagtctatgataccaatttgggaggggccgtttcat

SEQ ID NO: 532965 - DNA, 496 bp, Homo sapiens
  misc_feature: HEFZJCU01BU157.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaagtcactcccaatggtgatgggactgcctacgcacagaagtttcagggcagagtcaccatcgaccagggacacgtccacgagaacagactatttggagttgagcagcctgagatctgacgacacggccgtttatactgtgcgcgagataatagtcacaactggaacggcgttttggggt

SEQ ID NO: 532966 - DNA, 518 bp, Homo sapiens
  misc_feature: HEFZJCU01C0RY3.49.9.A09.1.454.heavy.3.raw
agtcgagagacacgaccggtgctcgatttagcgagacgcgcaggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagttgaccacgcggactctgtgaagggccgattcaccgtctccagagaaaacgccaagaacacggtgtatctgcaaatgactggcctgagagccgaggacgacgggcagttttattactgtgcaagaggtcttgtggtcactgtcgacctggactggtactgatctgtgggcgtggca

SEQ ID NO: 532967 - DNA, 378 bp, Homo sapiens
  misc_feature: HEFZJCU01COEAG.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatattattgtgttaaatgggatggtggctacgactcttggggccggggaaccctggtcaccgtctattcagcttccaccaagggcccatcggtcttccccctggcgccctgctccaggagcacctctgggggcacagcggccctgggctgcctggtcaaggactacttcctacgtgagct

SEQ ID NO: 532968 - DNA, 509 bp, Homo sapiens
  misc_feature: HEFZJCU01EW8IK.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacgagcggccctgggctgcctggtcaggactacttcctacgtcgtat

SEQ ID NO: 532969 - DNA, 516 bp, Homo sapiens
  misc_feature: HEFZJCU01EAUMQ.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctggcaggagtcgggcccaggactggtgaaggccttcggagaccctgtccctcacctgcactgtctctggtggctccatcagcagcagtacttacttctgggctggatccgccagcccccagggaaggggctggagtggattgggagtatttaccacagtgggagcgacctactacaacccgtccctcaaaagtcgaggcaccatatccgtagacacgtccaagaaccaattctccctgaagctgagctctgtgaccgccgcagacacggctgtctattactgtgcgacggcccgagcgcagtggtcttttgtagtcgtcctttgatagtgtcggggccgaacgggaccaagtggtaccg

SEQ ID NO: 532970 - DNA, 517 bp, Homo sapiens
  misc_feature: HEFZJCU01BN594.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctggaggacacggccatttactactgtgcggcgggggaggtgggacggagcttcgggttttcggagtttagtcatctactactttgaattc

SEQ ID NO: 532971 - DNA, 536 bp, Homo sapiens
  misc_feature: HEFZJCU01DCU8A.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactggggaaccccacctatgcccaggccttcacagggcggtttgtcttctccatggatacctctgtcgggacgggcttatctgcagataaccaaccttccaacctgacgacactgccgtttatttttgtacgtagagcgtcgtctgtcgagtggaattgactacgtggggccacgggaacccgtggtcaccgtctcctcacgcctccacc

SEQ ID NO: 532972 - DNA, 537 bp, Homo sapiens
  misc_feature: HEFZJCU01EUK5E.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcatcatctccagagacaattcccagaacatactgtctctgcaactcaataacctgagaggcgaggacgacggccatttatttctgtgcgaaggaggcatatgggaagtacgattttcgatccctccgcagtcgacactttgattactgggggtccggggaaccctgggtccgccgtctcctcacgcctccaccaagggccccagtcgtccttcccctggccaccctcctccaagacg

SEQ ID NO: 532973 - DNA, 502 bp, Homo sapiens
  misc_feature: HEFZJCU01DJIAK.11.71.G05.1.454.heavy.3.raw
cgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagccgaggacacgggccgtatatttctgtgcgtaaagatcgggcatatagtgtccg

SEQ ID NO: 532974 - DNA, 491 bp, Homo sapiens; identical to SEQ ID NO: 503539
  misc_feature: HEFZJCU01B2BL2.11.26.C04.1.454.heavy.3.raw

SEQ ID NO: 532975 - DNA, 497 bp, Homo sapiens
  misc_feature: HEFZJCU01CW8U9.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcaggactccgtgaagggccggttctccatctccagagacaattccaagaacacgctgtatctgcaattgaacagcctgagagccgaggaccgacggccgtatattactgtagcgaaagagtttggggaatgaccacgtc

SEQ ID NO: 532976 - DNA, 519 bp, Homo sapiens
  misc_feature: HEFZJCU01B1GYR.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacgagccggccgtcgggctgcctggtcaaggtactacttcccataccg

SEQ ID NO: 532977 - DNA, 497 bp, Homo sapiens
  misc_feature: HEFZJCU01ENUEF.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaagggctggagtgggtctcatccattagagtaatagtgcctacagatactacgcagactcactgaagggccgactcaccatctccagagacaacgccaagaactcactgtatctgcaaatgaacagcctgagagccgaggacacggctgtgtattactgtgcgagaggagctatatctggaaccccgat

SEQ ID NO: 532978 - DNA, 520 bp, Homo sapiens
  misc_feature: HEFZJCU01BB94G.4.66.F11.1.454.heavy.3.raw
  modified_base (422)..(422): a, c, t, g, unknown or other
  modified_base (453)..(453): a, c, t, g, unknown or other
  modified_base (468)..(468): a, c, t, g, unknown or other
  modified_base (482)..(482): a, c, t, g, unknown or other
agcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctgggggtcccttagactctcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagatgattacaaaagtacactgtanctggaaatgaacagcctgagaatcgacgacncagcctttattactncagagagggcactntgtccctgggccagggaaccctgtcaccgtctcctcag

SEQ ID NO: 532979 - DNA, 507 bp, Homo sapiens
  misc_feature: HEFZJCU01DDT3X.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacacgtctacatggatctgagcggactggacctctgacgacacggccatgtattactgtaggaagagacgttggtggctaccgcggggtctgaccacgtggggtaccg

SEQ ID NO: 532980 - DNA, 528 bp, Homo sapiens
  misc_feature: HEFZJCU01EG45Y.10.85.H08.1.454.heavy.3.raw
catagtagtgcacgaccggtgctcgatttagtatcactcagtcgcgggggagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcggagggggagccggctatggttcggacctcgtggggcccaggggaacccctggtctacccg

SEQ ID NO: 532981 - DNA, 518 bp, Homo sapiens
  misc_feature: HEFZJCU01BE7XP.10.79.H02.1.454.heavy.3.raw
  modified_base (357)..(357): a, c, t, g, unknown or other
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacattttancctagtggtgataccatatactacgcagactctgtgaagggcgattcacatctccagggacaacgccaagaactcactgacttgcaatgaacaccctgcgagccgagacacggccgtatattactgtgcgagaataacccgttcgcctggttactttaccg

SEQ ID NO: 532982 - DNA, 478 bp, Homo sapiens
  misc_feature: HEFZJCU01B9UUC.52.76.G10.1.454.heavy.3.raw
cgcagtacgacacgaccggtgctcgatttagtcactcatacagggggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgcagattctgcgaggggccgattcaccatatccagagacaactcccaagatatgatatatctacaaatgaacagcctgagacctgaggacacggctgtatattactgtgcgtcagggggcagtg

SEQ ID NO: 532983 - DNA, 514 bp, Homo sapiens
  misc_feature: HEFZJCU01CLRSV.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcaggggtctccatcgaaccggggacaggggcccatcagaacagcctacatggagctgaacagactgacatctgacgacacgggcccgttttattagtttgtgttgagagaacgggacccgaatgaccctcgggtcc

SEQ ID NO: 532984 - DNA, 532 bp, Homo sapiens
  misc_feature: HEFZJCU01A0QLX.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttggaggagcctgacatctgacgacacggccgtctattacgtgtgcgagacgtcccacgatccgggtgacgtcctaacgggcacggcggccgttttggacctttcgtggggggccctaagggggaccg

SEQ ID NO: 532985 - DNA, 500 bp, Homo sapiens
  misc_feature: HEFZJCU01EKN5V.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaagtcgaggcaccatataccgtagacacgtccaagaaccaattctccctgaagctgagctctgtgaccgccgcagacacggctgtctattactgtgcgaggccccgagcgcagtggtcttttgattgtccgtttgatatgtggggcgaagggacagt

SEQ ID NO: 532986 - DNA, 399 bp, Homo sapiens
  misc_feature: HEFZJCU01C3WHI.15.31.C09.1.454.heavy.3.raw
tctacgtagccacgaccggtgctcgatttagacgtctcatcaaggaaggaaggggctggagtgggtctcaactatcagtggtagtggtgttagcacatattacgcagactccgtgaagggccggttcaccatctccagagacaattccaagaacacgctgtatgttcaaatgaacagcctgagagccgaggacacggccgtatattactgtgcgaaagaccttgtgtatagcagtgcctggtaccaaggtgactactggggccagggaaccctggtcaccgtctcctcagcctccaccaagggcccatcggtcttccccctggcaccctcctccaagagcacctctgggggcacagcggccctgggctgcctggtcaaggactacttccgctacgtaga

SEQ ID NO: 532987 - DNA, 527 bp, Homo sapiens
  misc_feature: HEFZJCU01CLOBW.17.28.C06.1.454.heavy.3.raw
  modified_base (514)..(514): a, c, t, g, unknown or other
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtatactgtgcgagatgtggaaaaagtataggctgtgtttatgggccaggngcctggtccacgt

SEQ ID NO: 532988 - DNA, 510 bp, Homo sapiens; identical to SEQ ID NO: 462597
  misc_feature: HEFZJCU01CTJK6.16.21.B10.1.454.heavy.3.raw

SEQ ID NO: 532989 - DNA, 529 bp, Homo sapiens
  misc_feature: HEFZJCU01BBRWE.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgcggacaaattaacgaacacagttaatctgagctgaacagcctgtcatctgaggacacgggcttctacttctgtgcgaggagtaattactatacactgcttcttttacaccttccctgtacttctcggggccatcggaaccccggtcaccgt

SEQ ID NO: 532990 - DNA, 499 bp, Homo sapiens; identical to SEQ ID NO: 453198
  misc_feature: HEFZJCU01EUN3Z.11.71.G05.1.454.heavy.3.raw

SEQ ID NO: 532991 - DNA, 504 bp, Homo sapiens
  misc_feature: HEFZJCU01A8Q8E.51.78.H01.1.454.heavy.3.raw
cgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcaccttttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgacgcaaaagccaaggcaacagctggta

SEQ ID NO: 532992 - DNA, 443 bp, Homo sapiens
  misc_feature: HEFZJCU01AEQMA.49.81.H04.1.454.heavy.3.raw
  modified_base (260)..(260): a, c, t, g, unknown or other
agtcgagagacacgaccggtgctcgatttagtagtgtagattcgcggggtctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagccctgggaggtccctgagactctcctgtgtagtctcngggttcaccttcagggtctatgacatgcactggtccgccaggctccagcgagggctggagtcgggtggcagttatatcgaatggatggaagtaagaagtactagtgcagactccggtgaagggccgattcaaccatctcacgagacaatccaagaacacgctatatttgcacatgaacagcct

SEQ ID NO: 532993 - DNA, 527 bp, Homo sapiens
  misc_feature: HEFZJCU01CK7N2.52.28.C06.1.454.heavy.3.raw
cgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctggggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacgggccgtctattattgtgttgagagacggacccggatgaccctcgaaccagtgggaccgtcgtcgggggaccg

SEQ ID NO: 532994 - DNA, 513 bp, Homo sapiens
  misc_feature: HEFZJCU01DX9V4.53.61.F06.1.454.heavy.3.raw
cgcgtatacacacgaccggtgctcgatttagctacgctctaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaaccacgctgtatctgcaaatgaacggcctgagagctgaggacacggctgtgtattactgtgcgaacggttgagtgggaattaggggctgagtacggtatggacgtcgtgggccgaagggaccacggtccaccgtcctccgtc

SEQ ID NO: 532995 - DNA, 526 bp, Homo sapiens
  misc_feature: HEFZJCU01DSRXL.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagttggggcccacgaacgttactacgctatggacgtcgtgggggccaaggggacctac

SEQ ID NO: 532996 - DNA, 512 bp, Homo sapiens
  misc_feature: HEFZJCU01AOFAR.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaagggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagacaggtggta

SEQ ID NO: 532997 - DNA, 502 bp, Homo sapiens
  misc_feature: HEFZJCU01ECZWO.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgacaaatgaaacagcctgagagctgaggacacggctgtgtattactggtgggagagagtggaggtacgatattgtta

SEQ ID NO: 532998 - DNA, 517 bp, Homo sapiens
  misc_feature: HEFZJCU01AX47U.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaaccatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtcttcccctggcaccctcctccaacgagcacctctgggggcacagcggccctgggctgctggtcaggactacttcagacgtatca

SEQ ID NO: 532999 - DNA, 497 bp, Homo sapiens
  misc_feature: HEFZJCU01BMACW.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcgggacttctggggccagggaaccctggtcagcgtctctcagcctccaccaaggcccatcggtcttcccctggcgccctgctccaggagcacctccgagacgcacacgcggcccgtcgggcgtgccttggtcaaggactaccttcccgtaacgtgacgcgt

SEQ ID NO: 533000 - DNA, 508 bp, Homo sapiens
  misc_feature: HEFZJCU01DTTRE.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaggcataaagtggttcgacccctggggccagggaaccctggtcaccgtctcctcagcctccaccaacgggcccactcggtcttccccgtggccgccctgctcaggagcacctccgagagc

SEQ ID NO: 533001 - DNA, 546 bp, Homo sapiens
  misc_feature: HEFZJCU01D45CC.21.78.H01.1.454.heavy.3.raw
  modified_base (454)..(454): a, c, t, g, unknown or other
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccntgtattactgtgtgggggctagtttacttgacccctggggggcccgggggaacccgtcggtcaccgtccgtccccacccctcccacccgaac

SEQ ID NO: 533002 - DNA, 509 bp, Homo sapiens
  misc_feature: HEFZJCU01A2AWI.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccgggtgacgcctacggcagcggtcctttgactttcgtc

SEQ ID NO: 533003 - DNA, 537 bp, Homo sapiens
  misc_feature: HEFZJCU01ALERA.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgacagcctgtcatctgaggacacgggcttctacttctgtgcgaggagtaattactataacactcgctcctttttacaccttccctttgtacttctggggccagtacggaacccggtcccg

SEQ ID NO: 533004 - DNA, 506 bp, Homo sapiens
  misc_feature: HEFZJCU01B983G.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgttgttttcgattgcctttcggtccggcgggacttctcggggcc

SEQ ID NO: 533005 - DNA, 496 bp, Homo sapiens
  misc_feature: HEFZJCU01C9YS2.14.55.E11.1.454.heavy.3.raw
  modified_base (476)..(476): a, c, t, g, unknown or other
  modified_base (480)..(480): a, c, t, g, unknown or other
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggtttcctcgttagctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtatagaaagtatgccgacgccgtgaagggccgattcgaccatctccagagacaattccaacaacatgtgtatctgcaaatgaatagcctgagagccgaggacacggctgtgtattactgtgtcngagntgggagggggtggtga

SEQ ID NO: 533006 - DNA, 514 bp, Homo sapiens
  misc_feature: HEFZJCU01DBFR8.22.36.D03.1.454.heavy.3.raw
acatacgcgtcacgaccggtgctcgatttagctgcgtcacgatctctcttgggggagagaggagcccagccctgggattttcaggtgtttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccacgagacgattccgaaaacacagtgaatctgcaaatgtacagcctcagcgcgaggacacggccgtctacttctgtgcgaagacctctattttggccgtcggccgactactcgggccgac

SEQ ID NO: 533007 - DNA, 536 bp, Homo sapiens
  misc_feature: HEFZJCU01DSAJY.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagaacgacacggctgtctattattgcgcgagagagacacacgaacctactggccaatactatgggggcttgttcgtgggccgagggaccctggtcatcgtctccccagcctccaccaaggcccagtccgggtcctttcccccgtggccgcccgtcg

SEQ ID NO: 533008 - DNA, 526 bp, Homo sapiens
  misc_feature: HEFZJCU01CE1SJ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactgggccagggaccctggtcaccgtctcctcagcctccacc

SEQ ID NO: 533009 - DNA, 534 bp, Homo sapiens
  misc_feature: HEFZJCU01BNPHH.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttccccctggccgccctcgctccacggagcgacctccgacgacg

SEQ ID NO: 533010 - DNA, 357 bp, Homo sapiens
  misc_feature: HEFZJCU01EGDYB.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggcccctgggctgcctggtcaaggactacttcctacgtgagct

SEQ ID NO: 533011 - DNA, 505 bp, Homo sapiens
  misc_feature: HEFZJCU01CEFUI.13.79.H02.1.454.heavy.3.raw
tcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaatactatgtggactctgtgaagggccgattcaccatctccagagacaacgccaagaactcactgtatctgcaaatgaacagcctgagagccgaggacacggctggtctattactgtgcgagagagttgggggcggaaggtataggca

SEQ ID NO: 533012 - DNA, 528 bp, Homo sapiens
  misc_feature: HEFZJCU01EVTCO.40.26.C04.1.454.heavy.3.raw
tctagcgactcacgaccggtgctcgatttagtctagcgactttgggtttggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcgttttgtatgtcctttgtatatgtggggccgaaacgggacaagtggtcaccggtcctccttcacgtcctccaccaacgggccccacg

SEQ ID NO: 533013 - DNA, 531 bp, Homo sapiens
  misc_feature: HEFZJCU01AG9NX.17.33.C11.1.454.heavy.3.raw
cgtagactagcacgaccggtgctcgatttagagtgagctcgttgggtttggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaccaggtggtccttacaatgaccaatatggaccctgtggacacagccacatattactgttcacgctctatggttcgggggagttattagtaccctactttgactactggggtccgaggggaactctaggtcaccgttcctccgtcaggtccctcctaccaacggggtcccagttcc

SEQ ID NO: 533014 - DNA, 501 bp, Homo sapiens
  misc_feature: HEFZJCU01ATZNX.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaaggcccatcggtcttcccctggcgccctgctccaggagcacctccgagagcacagcggccctgggcgtgcctggtcgaaggactacgttccctactagtgacct

SEQ ID NO: 533015 - DNA, 528 bp, Homo sapiens
  misc_feature: HEFZJCU01CUOIM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctgggggccaggggaccctggtcatcgtctccccagccctccaccaagggcccatcggtccttcccctcggccg

SEQ ID NO: 533016 - DNA, 516 bp, Homo sapiens
  misc_feature: HEFZJCU01BGN3D.14.85.H08.1.454.heavy.3.raw
cgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgcccccagggaaggggctggagtggattggggaaatcagtcaaagtggaggcaccaagtacaacccgtccctcgagagtcgagtcaccatatcaatagacacgttccagaatcagttctccctgaggctgacttctgtgacagccgcggacacggctgtgtattactgtgcgagatctttcggcttggtacgctcttgactactgggggccagggaaccctggtcaccgtctctttcacgtcctcccaccaacggg

SEQ ID NO: 533017 - DNA, 509 bp, Homo sapiens
  misc_feature: HEFZJCU01EYFXW.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagaacgtaaaagtgacgtggtagttccggggggacgacatgacaccg

SEQ ID NO: 533018 - DNA, 500 bp, Homo sapiens
  misc_feature: HEFZJCU01CZFOX.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctgactttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtaatagttactggtgacgaaaggtatttggggaatcgaccacgtc

SEQ ID NO: 533019 - DNA, 492 bp, Homo sapiens
  misc_feature: HEFZJCU01BCB0G.13.86.H09.1.454.heavy.3.raw
  modified_base (435)..(435): a, c, t, g, unknown or other
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattccacatgacgacagacacatacacgaacacagcctacatggaggtgaggagcctgagatatgacganaccggccgtgtattattgtgcgagagtggagtggcagtggatatcgacaaattacta

SEQ ID NO: 533020 - DNA, 508 bp, Homo sapiens
  misc_feature: HEFZJCU01DKQPK.3.63.F08.1.454.heavy.3.raw
agacgcactccacgaccggtgctcgatttagcgatcgtataaggggctctgagagaggagccttagccctggattccaaggcctatccacttggtgatcagcactgaggcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattccaccttcagtagctactagcatgaactgggtccgccaggctccagggaaggggctggagtgggtctcatccatagtagtagtagtagttacatatactacgcagactcagtgaaggccgattcacctatctccagagacaacgccaagaactcactgtatctgcaatgaacagctcgagagccgaagacacggctggtgtattactgtgcgagtttgtttgggcggtatagccaggccgggtaccc

SEQ ID NO: 533021 - DNA, 501 bp, Homo sapiens
  misc_feature: HEFZJCU01A6TEE.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggaggtgggtggcagcaatatcatatgatggaagtgataaatattacatagagtccgtgaagggtcgattcaccatctccagagacaatcgcaagaacacactgtatctggaatgaccagcctgagaggtgacgacacgggtgttttattactgtgcgcgggatagaggctacgatcggtggatacaact

SEQ ID NO: 533022 - DNA, 532 bp, Homo sapiens
  misc_feature: HEFZJCU01EI31S.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctaatgccagtgggaccgcatctacaacccgtccctcaagagtcgagtcagcatgtcagtcgacacgtcccagaaccagttctccctgacagtgagttatatgaccgccgcagacacggccgtgtattactgtgcgagagagggccgtttattttacggaccagcttagttaaaaacttcctactacggtctggacgtcgtcgggggccgaggggaccgtaaac

SEQ ID NO: 533023 - DNA, 520 bp, Homo sapiens
  misc_feature: HEFZJCU01B9X5M.16.27.C05.1.454.heavy.3.raw
  modified_base (472)..(472): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatgacatacactgggtccgccaggctccaggcaaggggctgaagtgggtggcgtttatttcatatgatggaactactcaacactatccagactccggggagggccgattccaccgtctccagagacaattcccaagaacagggtgtttctccaagtgattgatctgagaagtgaggacacggctgtttatactgtncgcggtgctgaccgctcgttgactacgtgggggccgggacgcccggtc

SEQ ID NO: 533024 - DNA, 483 bp, Homo sapiens
  misc_feature: HEFZJCU01EYJKZ.4.37.D04.1.454.heavy.3.raw
  modified_base (476)..(476): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcctgagtggatgggatggatcgaccctaacagcggtggcacaaagtatgcacagaagtttcaggggcaggggtcaccatgaccagggacacgtccatcagcacgtccatcagcacagcctacatggacctggagcggcctgacatctgacgacacggccgtatatttctgtncggaggg

SEQ ID NO: 533025 - DNA, 531 bp, Homo sapiens
  misc_feature: HEFZJCU01EGGIE.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgagggacacggctgtatattattgtgtgagattagcgcactactttgactactggggccagggaacccgtggtcaccgt

SEQ ID NO: 533026 - DNA, 504 bp, Homo sapiens
  misc_feature: HEFZJCU01B6V1J.48.59.F04.1.454.heavy.3.raw
agtatacatacacgaccggtgctcgatttagtacacacacttagggattgggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctcctgaagctgagctctgtgaccgccgcagacacggctgtctattactgtgcgaggccccgagcgcagtggcttttgatgcctttgatatgtggggccagggacaatggtcaccgtcc

SEQ ID NO: 533027 - DNA, 542 bp, Homo sapiens
  misc_feature: HEFZJCU01DP7CX.21.78.H01.1.454.heavy.3.raw
  modified_base (472)..(472): a, c, t, g, unknown or other
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggnatttacttgaacccctgggggcccggggaacccgtggtcaccgtctaccccgacccctcccaccgaaacc

SEQ ID NO: 533028 - DNA, 521 bp, Homo sapiens
  misc_feature: HEFZJCU01DYDH2.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggaccctcaccctggttctacttcgatctcgtc

SEQ ID NO: 533029 - DNA, 495 bp, Homo sapiens
  misc_feature: HEFZJCU01ELUFD.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaccaggtggtccttacaatgaccaacatggaccctgtggacacagccacatattactgtgcacagaagatacgggcagcacgtgggttggggctactggggccagggaaccctggtcacgtcctctcagcctccaccg

SEQ ID NO: 533030 - DNA, 511 bp, Homo sapiens
  misc_feature: HEFZJCU01D5U12.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaaccagcggagttcaagtactcctttgacgtctcgggc

SEQ ID NO: 533031 - DNA, 535 bp, Homo sapiens
  misc_feature: HEFZJCU01CGFU8.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggccaccctcctccagagcacctcgtcgggggcac

SEQ ID NO: 533032 - DNA, 509 bp, Homo sapiens
  misc_feature: HEFZJCU01AECGU.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattacgtcccttactttgactactggggccagggaactcgtggtcaccgtcctccgcagcctccacc

SEQ ID NO: 533033 - DNA, 500 bp, Homo sapiens
  misc_feature: HEFZJCU01CS6OK.17.10.A10.1.454.heavy.3.raw
  modified_base (459)..(459): a, c, t, g, unknown or other
  modified_base (463)..(463): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcagattaccacggacacccccacgaacacagtctacatgcaactgacgagcctgagagctgacgacacggccgtctattactgtgcgagaatgttttcngtcntcgtacaatttgatagctctatggactggacttcgtc

SEQ ID NO: 533034 - DNA, 316 bp, Homo sapiens
  misc_feature: HEFZJCU01C3QX8.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaaagagcacctctggggcacagcggccctgggctgcctggtcaaggactacttcctacgtgagct

SEQ ID NO: 533035 - DNA, 503 bp, Homo sapiens
  misc_feature: HEFZJCU01BCHJU.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacggtccatcagcactgcctacatggagctgaccaggctgaaatttggaggacgacggcatttattactgtgcaaggaacagcaataatgactccgtccccggtactttacg

SEQ ID NO: 533036 - DNA, 442 bp, Homo sapiens; identical to SEQ ID NO: 446170
  misc_feature: HEFZJCU01DKUAK.10.11.A11.1.454.heavy.3.raw

SEQ ID NO: 533037 - DNA, 396 bp, Homo sapiens; identical to SEQ ID NO: 444568
  misc_feature: HEFZJCU01CD3RU.47.46.E02.1.454.heavy.3.raw

SEQ ID NO: 533038 - DNA, 523 bp, Homo sapiens
  misc_feature: HEFZJCU01BXS4X.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgcccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccg

SEQ ID NO: 533039 - DNA, 502 bp, Homo sapiens
  misc_feature: HEFZJCU01CXW99.13.76.G10.1.454.heavy.3.raw
  modified_base (320)..(320): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtntcttttatttatagtagtggtagtacatactccgcagactccgtgaggggccattcaccatctccagagacaattccaagaacacgctgtttcttcaaatgaacagcctgagagccgatgacacggccgtgtattactgtgcgagagatggggcccacgaacgttactacgctatggacgtc

SEQ ID NO: 533040 - DNA, 513 bp, Homo sapiens
  misc_feature: HEFZJCU01EQ0OK.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgacgcctacggcagcggtcctttgacttcgtgggggccaggggacg

SEQ ID NO: 533041 - DNA, 399 bp, Homo sapiens
  misc_feature: HEFZJCU01DX4Z2.4.60.F05.1.454.heavy.3.raw
  modified_base (242)..(242): a, c, t, g, unknown or other
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggntaactttgactactggggccagggaaccctggtcaccgtctcctcagcctccaccaagggcccatcggtcttccccctggtcgccctgctccaggagcacctccgagagcacagcggccctgggctgcctggtcaaggactacttccctacagtgct

SEQ ID NO: 533042 - DNA, 488 bp, Homo sapiens
  misc_feature: HEFZJCU01BY39L.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccagggcccatcggtcttcccctggcgccctgctccaggagcacctccgagagcacagcggccctgggctgcctggtcaaggactacttcccatactcgta

SEQ ID NO: 533043 - DNA, 504 bp, Homo sapiens
  misc_feature: HEFZJCU01B3RIX.22.86.H09.1.454.heavy.3.raw
  modified_base (499)..(499): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccagggcccatcggtctcccctgccgcctcgctcnggacg

SEQ ID NO: 533044 - DNA, 506 bp, Homo sapiens
  misc_feature: HEFZJCU01CC1DG.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattacctgtgcgagaattgttttctgtcatcgtacaatttgataggctctatggactggactttcgtac

SEQ ID NO: 533045 - DNA, 513 bp, Homo sapiens
  misc_feature: HEFZJCU01EN98U.51.54.E10.1.454.heavy.3.raw
cgatcgtatacacgaccggtgctcgatttagatcgtagcagaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgtacacacggccgtctattactgttgcgacagaagcggcggacaggacggttcgcttacctggttcgacggtctt

SEQ ID NO: 533046 - DNA, 475 bp, Homo sapiens
  misc_feature: HEFZJCU01EIP25.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggccctggacaagggcttgagtggatgggatggatctatcctaccagtggtggcacacgctattcacagaagtttcagggcaggggtcaccgatgaccagggacacggtccatcagcacagcctacatggaattgagcaggctgacatctgacgacacggccgtgtattattgtgcgagagcctc

SEQ ID NO: 533047 - DNA, 544 bp, Homo sapiens
  misc_feature: HEFZJCU01EA7DB.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattgggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtataggctgttgtttattcgggggccaggggagcccgtggtcctaccg

SEQ ID NO: 533048 - DNA, 522 bp, Homo sapiens
  misc_feature: HEFZJCU01DCROL.3.82.H05.1.454.heavy.3.raw
  modified_base (294)..(294): a, c, t, g, unknown or other
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccnccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattacctgtagcgagagattcgagtggttcggggacctcgaccctggttctacttcgatctctc

SEQ ID NO: 533049 - DNA, 516 bp, Homo sapiens
  misc_feature: HEFZJCU01B3EZ8.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctaccagagacaattccaagaacacactgtatctgcaaatgaacagcctgagagccgacgacacggccatatattactgtgacgaaagcaccggcagttagtacacccatacctactttgactacgtggggaccg

SEQ ID NO: 533050 - DNA, 383 bp, Homo sapiens
  misc_feature: HEFZJCU01DJALI.11.61.F06.1.454.heavy.3.raw
cgagagataccacgaccggtgctcgatttagctacgctctaagggaaggggctggtgtgggtctcacgtattgacaatgatgggagtgacacaatccacgcggattctgcgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaaccgtctcttcagcctccaccaagggcccatcggtcttccccctggcgccctgctccaggagcacctccgagagcacagcggccctgggctgcctggtcaggactacttccgtatctctcg

SEQ ID NO: 533051 - DNA, 506 bp, Homo sapiens
  misc_feature: HEFZJCU01EH3SL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctcggacaacgacctgagtggatgggatgggcgaaccctaacactggtgtcacagtgtcttcacccatccctccgggacagacttaccatgaccacgaacctcctccataaacacagcctacatggagttggaggagcctgacatctgacgacacggccgtctattactgtgcgagagtcccagactccggtgagccctacggcacggcggtcctttgac

SEQ ID NO: 533052 - DNA, 521 bp, Homo sapiens
  misc_feature: HEFZJCU01CP3JT.16.86.H09.1.454.heavy.3.raw
  modified_base (511)..(511): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagtaaccagttctccctgaagctgacctttgtgactgccgcggacacggccgtgtattactgtgcgagagaccctccgatagcagtggctggtccacgtaggtttgactactggggccagggaagcttggtcaccgtntcctcagcct

SEQ ID NO: 533053 - DNA, 309 bp, Homo sapiens; identical to SEQ ID NO: 444418
  misc_feature: HEFZJCU01D74HZ.18.53.E09.1.454.heavy.3.raw

SEQ ID NO: 533054 - DNA, 497 bp, Homo sapiens
  misc_feature: HEFZJCU01B9VTS.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagacacgcagtatctgcaaatgaacagcctgtagagctgaggacacggctgtgtattacgtgtgggagagaagtggaggtcgatattgtta

SEQ ID NO: 533055 - DNA, 490 bp, Homo sapiens
  misc_feature: HEFZJCU01DN2YO.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggacctggtcaccgtctcctcggcctccaccaagggcccatcggtcttcccctggcgccctgctccaggagcacctccgagagcacagcgccctgggctgcctggtccaaggactacttccctacagtgct

SEQ ID NO: 533056 - DNA, 509 bp, Homo sapiens
  misc_feature: HEFZJCU01D0HL5.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaaggggattggagtgggtggcagttgtttcatctgagggcagtgttcaatggtatgcagactccgtgaagggccgattcaccatctccagagacaattccaggaacacaatgtatttggagctagaacagcctaagtcctgaggacacgggcgtatactactgtacgaaggaaggggggacagcggagttccaagtactctttg

SEQ ID NO: 533057 - DNA, 503 bp, Homo sapiens
  misc_feature: HEFZJCU01CSFV1.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgatcgt

SEQ ID NO: 533058 - DNA, 526 bp, Homo sapiens
  misc_feature: HEFZJCU01BZJZS.2.85.H08.1.454.heavy.3.raw
  modified_base (434)..(434): a, c, t, g, unknown or other
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggcttgagtggctgggggggatcatccctatgttggtgaagcaaattacgcacagaagttccggggaagagtctcgattaccgacggacgaatccacgaacacagcctacatggaagtgaccagcctgagatctgaagacacggccgtgtattactgtgcgaagtcgtattactntgatactggtgattagtttgaatttcgactccctaccactacggtatggacgttcgtggggccgagggggtaccacggtcaccgtcttcttc

SEQ ID NO: 533059 - DNA, 445 bp, Homo sapiens; identical to SEQ ID NO: 445213
  misc_feature: HEFZJCU01CLZZF.3.86.H09.1.454.heavy.3.raw

SEQ ID NO: 533060 - DNA, 523 bp, Homo sapiens
  misc_feature: HEFZJCU01DOVT7.3.82.H05.1.454.heavy.3.raw
  modified_base (426)..(426): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtggaagggccgattaaccatctccagagacgattccgagaacacggtgtatcttcaaatnaacaacctgagagccgacgacacggccgtttattactgtgcgagagattcgagtggttcggggacctcacctggttctacttcgatctcgtggggcc

SEQ ID NO: 533061 - DNA, 522 bp, Homo sapiens
  misc_feature: HEFZJCU01CS619.2.81.H04.1.454.heavy.3.raw
  modified_base (410)..(410): a, c, t, g, unknown or other
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacggatgggaagtgagaaaaactangtggactccgtgaagggccgattcaccatctccagagacaacgacaagaatttagtgtatctgcaaatgagcagcctgagagccgaggacacggctgtgtattatgtgcgag

SEQ ID NO: 533062 - DNA, 504 bp, Homo sapiens
  misc_feature: HEFZJCU01ELFM8.17.10.A10.1.454.heavy.3.raw
  modified_base (215)..(215): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactntctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggaccacccccacgaacacagtctacatgcaactgacgagcctgagagctgacgacacggccgtctattactgtgcgagaattgttttctgtcatcgtacatttgataggctctatggactggtacttcgtc

SEQ ID NO: 533063 - DNA, 498 bp, Homo sapiens
  misc_feature: HEFZJCU01BA0Z8.49.38.D05.1.454.heavy.3.raw
agtcgagagacacgaccggtgctcgatttagtatctgatagttgggtttgggggacggagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctggggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattccaccatctccagagacaattccaagaacacactatatcttcaaatgaacactctgagtacgtgaggacacggctagtctattactgtgcgactggagatgtactttattacgt

SEQ ID NO: 533064 - DNA, 504 bp, Homo sapiens
  misc_feature: HEFZJCU01C2VVK.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccaacgaaccacagtctacatgcaactgacgagcctgagagctgacgacacggccgtctattactgtgcgagaatgttttctgtcatcgtacaatttgataggctctatggactggacttcgtc

SEQ ID NO: 533065 - DNA, 504 bp, Homo sapiens
  misc_feature: HEFZJCU01CD9ZF.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctagaagccgaggacacggctgtgtattactgtgcgagaggagctatatctggaacccgatcgcttt

SEQ ID NO: 533066 - DNA, 514 bp, Homo sapiens
  misc_feature: HEFZJCU01C0G5X.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattacgtcctactttgactactggggccagggaactctggtcaccgtctccgcagcctccaccaaggggccc

SEQ ID NO: 533067 - DNA, 528 bp, Homo sapiens
  misc_feature: HEFZJCU01BA3OX.10.53.E09.1.454.heavy.3.raw
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctcaaagacaatttgaagaacacgctgtttctgcaaatagaacagcctgagagctgaggacgacggctgtgtattactgtttcgttttggttcgttgtacgtcggtcgggggtaacgttaccttacagcacgtc

SEQ ID NO: 533068 - DNA, 501 bp, Homo sapiens
  misc_feature: HEFZJCU01ALXMM.11.71.G05.1.454.heavy.3.raw
  modified_base (479)..(479): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaaatgtgacttctattcagactccgtgaagggccgattcaccgtctccagagacaattccaggcacacgctgtatctgcaaatgaacagcctgagagctgaggacacggctgtgtattactgtgcgaaagntttactatagaggtgacgttac

SEQ ID NO: 533069 - DNA, 512 bp, Homo sapiens
  misc_feature: HEFZJCU01DXKXZ.48.22.B11.1.454.heavy.3.raw
agtatacatacacgaccggtgctcgatttagacgacagctcaggggagctctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaaagaacacggcgtatctgcaaatgaacagcctagaaaaccgaggacacggccattttattttgtgctagatctgaagaattaccagctgctgtgttct

SEQ ID NO: 533070 - DNA, 474 bp, Homo sapiens
  misc_feature: HEFZJCU01DWNC7.48.53.E09.1.454.heavy.3.raw
  modified_base (460)..(460): a, c, t, g, unknown or other
agtatacatacacgaccggtgctcgatttagagagagtgtgttgggtttggggtctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactaccggtaaaggccgattcaccatctccagagaagacgccaagaattccttgtatcttcagatgaacagtctgagaaccgatgacacggntgtgtattattgtt

SEQ ID NO: 533071 - DNA, 377 bp, Homo sapiens
  misc_feature: HEFZJCU01D04L4.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttggggcggaattcgggactgtggggccagggaaccctggtcagcgtctcagcctccaccaagggcccatcggtcttccccctggcgccctgctccaggagcacctccgagagcacagcggccctgggctgcctggtccaaggactacttcctagagacaccg

SEQ ID NO: 533072 - DNA, 514 bp, Homo sapiens
  misc_feature: HEFZJCU01B9J2Y.14.14.B03.1.454.heavy.3.raw
  modified_base (353)..(353): a, c, t, g, unknown or other
  modified_base (505)..(505): a, c, t, g, unknown or other
  modified_base (508)..(508): a, c, t, g, unknown or other
cgtctagtaccacgaccggtgctcgatttagtgtgagtagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaactgcagtgtcctacgcagactctctgaagggccgattcaccgtctccagggacaacgccaagaactcgctgtatctgcaaatcgacggcctgagngtcgaggacacggccatgtattactgtgcgagagtgtggttcggtcatgttttagaagttggggcttttgaccactgggccagggaaccctggtcaccgtctcttcagcctcaccagggcccatcgtcttcccctggcaccctcctccaagngcncctctc

SEQ ID NO: 533073 - DNA, 511 bp, Homo sapiens
  misc_feature: HEFZJCU01ESN74.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatgacagcctgagagtcgaaagacacggctggtgtattactgtgtgtctctgacgcctcggccggtaccgttgctttcgg

SEQ ID NO: 533074 - DNA, 544 bp, Homo sapiens
  misc_feature: HEFZJCU01AUIBR.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtccaccgtctccctcacggccctccaacccaacgggccccgatccggtcctttcccccgtggccacccctccctcccaacgtacgg

SEQ ID NO: 533075 - DNA, 513 bp, Homo sapiens
  misc_feature: HEFZJCU01B8BLS.7.28.C06.1.454.heavy.3.raw
cgtgtctctacacgaccggtgctcgatttagagctcacgtattgggtttggggaggtctcagagaggagccttagccctggactccaaggcctttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggcctgggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatacgtgggccagggaaccctggtcgccg

SEQ ID NO: 533076 - DNA, 513 bp, Homo sapiens
  misc_feature: HEFZJCU01A6868.10.38.D05.1.454.heavy.3.raw
  modified_base (478)..(478): a, c, t, g, unknown or other
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccacttttgaggttcaactggtggagactggaggaggctggatccagcctggggggtccctgagactctcctgtgcagcctctgggttcagcatcagtaacgactacatgacctggcccgccaggctccaggggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacntgactacgctcaattctggggtccagggacgcccg

SEQ ID NO: 533077 - DNA, 532 bp, Homo sapiens
  misc_feature: HEFZJCU01C0EHV.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggtcaccatctccagagatgattcagagaacacggcgtatctgacaatagaacagcctagaaaaccgaggacacggccgtgtattactgtgccagacactccgtcgttacttaacgttacttttttactacgttcggtcccg

SEQ ID NO: 533078 - DNA, 533 bp, Homo sapiens
  misc_feature: HEFZJCU01A5RBW.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccaccgtatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctcctcagcctccaccgaacggg

SEQ ID NO: 533079 - DNA, 506 bp, Homo sapiens
  misc_feature: HEFZJCU01CR0KT.53.61.F06.1.454.heavy.3.raw
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccacctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtagaagggccgattcaccatctcgagagacaattccaggaacacgctgtatctgcaatgaacgcctgagagctgaggacacggctgtgtattactgtgcgtaaacggttgagtgggtaagttaggggtcg

SEQ ID NO: 533080 - DNA, 514 bp, Homo sapiens
  misc_feature: HEFZJCU01A00Y0.13.36.D03.1.454.heavy.3.raw
  modified_base (184)..(184): a, c, t, g, unknown or other
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcncagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttactccctgagggtgagctctgtgaccgccgcggacacggctgtgtacttctgtgcgagaggcaatttttggactcgtcattctccctttgacttctggggccagggaaccctagtcaccgtc

SEQ ID NO: 533081 - DNA, 304 bp, Homo sapiens
  misc_feature: HEFZJCU01C2X91.7.71.G05.1.454.heavy.3.raw
cgtgtctctacacgaccggtgctcgatttagtgtcgtcgcaagagagagggggagcctctgggagaggaagcccgacggctacctagtaagtcggcggtgtttccattcgtgaatcagcgactgaacacagaggtacgtcaccaatggggttacgtttggggtctcgtaacctttaggggtttttcccgttcggttttcgacttcgtttttaaagaaggggttggtcccaagttggttccgaaaggttcgtcgggaaaccgttggggttggggtacgttcgttcgggggggtaggggaccggtt

SEQ ID NO: 533082 - DNA, 524 bp, Homo sapiens
  misc_feature: HEFZJCU01A3YU5.16.27.C05.1.454.heavy.3.raw
tgtactactccacgaccggtgctcgatttagacgcgatcgaagggtttgggggggagaggagcccagcattagaacgtcggcggtgtttccattcggtgatcagcactgaacacagaggactcaccatggagtttgggctgacctgggttttcctcgttggtcttttaagaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagccaccggcagttacgtcacccatactactttgactactggggccac

SEQ ID NO: 533083 - DNA, 536 bp, Homo sapiens
  misc_feature: HEFZJCU01CY2UG.17.28.C06.1.454.heavy.3.raw
cgtagactagcacgaccggtgctcgatttagagctcacgtattgggtttggggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaaggggctggagtgggtggccaacataaagcaagatggaactgccgagttttacgtggactctgtgaagggccgttcaccatctccagagacaacgccaagaattcactgtatctacaactgaacagcctgagagtcgcagacacggccgtgtattactgtgcgagatgtggaaaaagtaatggctgttgtttagttgggccagggagcccgtggtcaccgtctcctcacgcct

SEQ ID NO: 533084 - DNA, 517 bp, Homo sapiens
  misc_feature: HEFZJCU01CXA0I.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccgagggaaggggctggagtgggtctcatccattagtagtagtagtagttacatatactacgcagactcagtgaagggccgattcaccatctcagagacaacgccaagaactcactgtatctgcaaatgaacagcctgagaggccgaggaccacggcttggtgttattactgtagcgtagttttggtttggggcggggatacgcaggcggggtaccc

SEQ ID NO: 533085 - DNA, 514 bp, Homo sapiens
  misc_feature: HEFZJCU01D30CB.3.82.H05.1.454.heavy.3.raw
  modified_base (438)..(438): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgaganccgacgacacggccgtttattactgtgcgagagattgagtgggttcggggacctcaccctggttctacttcgatct

SEQ ID NO: 533086 - DNA, 514 bp, Homo sapiens
  misc_feature: HEFZJCU01AH1RR.52.23.C01.1.454.heavy.3.raw
cgcagtacgacacgaccggtgctcgatttagtacacgtgattagggattgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctgggagtgggtggcatttatatcaaatgatggaaataagaaatactatatagactccgtgaggggccgattcaccatctccagagacaattccaagaacacgctgtatctgcacatgaacagcctgagagccgaagacacgggtgtttattactgtgcgaacttaattacggaggacaacggtaatgcccgtccgccg

SEQ ID NO: 533087 - DNA, 508 bp, Homo sapiens
  misc_feature: HEFZJCU01A3WRS.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaacccctggtcaccgtctcctcagcctccaccaagggcccatcggtcttcccctggcaccctcctccaagagcacctctgggggcacagcggccctgggctgcctggtcaggactactcctacgtcgtat

SEQ ID NO: 533088 - DNA, 490 bp, Homo sapiens
  misc_feature: HEFZJCU01B86A1.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgagtgggactcatgaacaatatgcagactccgtgaagggccgattcatcatctccagagacaactccaacaacacactggatctaccaatgaacagcctgagagtcgaggacacggccgtatattattggtgtcccttgattacta

SEQ ID NO: 533089 - DNA, 515 bp, Homo sapiens
  misc_feature: HEFZJCU01BV58R.52.36.D03.1.454.heavy.3.raw
cgcagtacgacacgaccggtgctcgatttagctgcgtcacgatctctcttgggggctctgggagaggagctccagccttgggattcccagctgtctccactcggtgatcggcactgaaaacaggagactcagtatggagtttgggctgagctgggttttccttgttgctattttaaaaggtgtccagtgtgagatgcagctggtggagtctggggggaggcttggtccagcctggggggtccctgaaactctcctgtacagcctctgggttccccttcagtggcactgctatgcactgggtccgccaggtttccgggaaagggctggagtgggttggccgcatcagaggcaaggcaaaaagtcacgcgacggcatatgctgcgtcggtgaaaggcaggttcaccatctccagagatgatcagataacacggcgtatctgcaatgaacaactagaaaaccgagacacggccgtgtattattgtagtagacagtttcggggggttctagaaggtgcc

SEQ ID NO: 533090 - DNA, 490 bp, Homo sapiens
  misc_feature: HEFZJCU01B9JKW.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagccgtacggcaggcggccttt

SEQ ID NO: 533091 - DNA, 517 bp, Homo sapiens
  misc_feature: HEFZJCU01A2KL4.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtcttattattgcgcgagagagacacacgaacctactggccaatactatgggggcttggttctggggccaggggaccctggtcatcgtctccccagcctccaccaagggccatcggtcttcccc

SEQ ID NO: 533092 - DNA, 517 bp, Homo sapiens
  misc_feature: HEFZJCU01CEP1T.13.76.G10.1.454.heavy.3.raw
  modified_base (495)..(495): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccatctccagagacaattccaagaacacgctgtttcttcaaatgaacagcctgagagccgatgacacggccgtgtattactgtgcgagagatggggcccacgaacgttactacgctanggacgtctcggggcagggaccg

SEQ ID NO: 533093 - DNA, 517 bp, Homo sapiens
  misc_feature: HEFZJCU01BW4H1.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccgggaaccctggtcaccgtctcccacctccaccaagggcccatcggtcttccccctggcaccctcctccagagcacctctgggggcacagcggccctgggctgcctggtcaagggactacgttcccat

SEQ ID NO: 533094 - DNA, 536 bp, Homo sapiens
  misc_feature: HEFZJCU01DCFFN.17.28.C06.1.454.heavy.3.raw
  modified_base (370)..(370): a, c, t, g, unknown or other
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcacttagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatggtaggaaaaagtaatggctgtgtttattggggcaggganccctggtcaccgt

SEQ ID NO: 533095 - DNA, 560 bp, Homo sapiens
  misc_feature: HEFZJCU01DFLFW.47.6.A06.1.454.heavy.3.raw
agctcacgtacacgaccggtgctcgatttagatctactgacagcacacaaggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctcgaagttgaactcagtgaccgctgcggacacggccgtgtattactgtgcgagccaccaccgattaccgatttttggagtggccgtttgataaacttgggggacccagggggagtcccgtggtccacccggttaccttcccgttccaaggcccttccccgacccgaaacc

SEQ ID NO: 533096 - DNA, 499 bp, Homo sapiens
  misc_feature: HEFZJCU01C79RI.51.27.C05.1.454.heavy.3.raw
cgatcgtatacacgaccggtgctcgatttagacgcgatcgaagggtttgggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctggggggagcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctagaagacgtacggctagtacttaattactagtggaccgtaacgtttaa

SEQ ID NO: 533097 - DNA, 508 bp, Homo sapiens
  misc_feature: HEFZJCU01DM1LI.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactgggggccagggaaccctggtcaccgtctcctcacgcctccaaccg

SEQ ID NO: 533098 - DNA, 493 bp, Homo sapiens
  misc_feature: HEFZJCU01AJPSJ.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtacctatgctatgcactgggtccgccaggctccaggcgaggggctggagtgggtggcggattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgataattgt

SEQ ID NO: 533099 - DNA, 539 bp, Homo sapiens
  misc_feature: HEFZJCU01B88XO.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccaggggcagagtcaccctgaccacagagacatccacgacccacagtctacagtggagctgtggagcctgagacctgacgacgacggccctctattacgtgtgcggacggccctacgttcctaacgagtacgaccctaactacccgacgtcctcgggttccgtacctcgtcgggggtaccaacc

SEQ ID NO: 533100 - DNA, 494 bp, Homo sapiens
  misc_feature: HEFZJCU01D5NWS.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctacttactgtgcgagagagttgacgagtct

SEQ ID NO: 533101 - DNA, 510 bp, Homo sapiens
  misc_feature: HEFZJCU01BMT4A.10.30.C08.1.454.heavy.3.raw
catagtagtgcacgaccggtgctcgatttagtctgacgtcaaagggaaaggggtgggagaggtagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcgaccatctccagagacaacgccaggaactccctctatctacaatgaacagtctgagacctgaggacacgggccttatatttactgttgcaaaagatcttggagcgtggccgtgaccacgt

SEQ ID NO: 533102 - DNA, 509 bp, Homo sapiens; identical to SEQ ID NO: 444586
  misc_feature: HEFZJCU01DRRMF.12.78.H01.1.454.heavy.3.raw

SEQ ID NO: 533103 - DNA, 379 bp, Homo sapiens; identical to SEQ ID NO: 444450
  misc_feature: HEFZJCU01AZK8D.47.77.G11.1.454.heavy.3.raw

SEQ ID NO: 533104 - DNA, 530 bp, Homo sapiens
  misc_feature: HEFZJCU01A2RTS.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgaccttttgtgactgccgcggacacggccgtgtatttactgtgcgagagacccctccgatagcaggtggctgggtccactaggttttgacttactgggggccaggggaagctttggtcaccgtctcctcagccct

SEQ ID NO: 533105 - DNA, 544 bp, Homo sapiens
  misc_feature: HEFZJCU01A4L0C.16.39.D06.1.454.heavy.3.raw
tgtactactccacgaccggtgctcgatttagtgacatctcgcagttctttgggttttggggagaggagcccagcactgggattccgaggtgtttccattcagtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatggggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttagtgggtaggtaattcggggcccctgggggccaggggaaccgtggtcaccgtctcctcagcct

SEQ ID NO: 533106 - DNA, 539 bp, Homo sapiens
  misc_feature: HEFZJCU01AZO2Y.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggattacaccttcagtcattatcatatactctgggtgcgacaggcccctggacaagggcttgagtggatagggcggatcccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctgggtcaccgtctcctcagcctccaccaagggcccatccggtcttcccctggccgccctcgctccaggacgcgtacctcccgagacggcacacgcggccccgtggggccg

SEQ ID NO: 533107 - DNA, 539 bp, Homo sapiens
  misc_feature: HEFZJCU01BZB3I.14.38.D05.1.454.heavy.3.raw
cgtctagtaccacgaccggtgctcgatttagtatctgatagttgggtttgggggggaaatactttctgagactcatggacctcctgcacaagaacatgaaacacctgtggttcttcctcctcctggtggcagctcccagatgggtcctgtcccaggtgcagctgcgggagtcgggcccaggactggtgaagccctcggggaccctgtccctcacctgcgctgtctctggtggctccatcagcagtactaactggtggagttgggtccgccagcccccagggaaggggctggagtggattggacaaatctatcgtagtgggagcaccaactacaacccgtccctcaagactcgagtcaccatatcaatagacacatccaagaatcaattctccctgaagctgagctctgtgaccgccgcggacacggccgtctactactgtgcgagaacaatcggtgctacgtcttttggagtgaacggctggttcgacccctggggccaggggaacccaggtccaccgtctccctcacgcctccacccg

SEQ ID NO: 533108 - DNA, 505 bp, Homo sapiens
  misc_feature: HEFZJCU01DFBGY.10.21.B10.1.454.heavy.3.raw
  modified_base (472)..(472): a, c, t, g, unknown or other
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcccggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgacaaatgaccagcctgagacggaccgaaggacgacggggtnttttaattactggtagggagtaaagtcctaggt

SEQ ID NO: 533109 - DNA, 521 bp, Homo sapiens
  misc_feature: HEFZJCU01DTVP0.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactggagtggcctgagatctgaaggacacggcttgtttattactgtgcggagagggaaggtgggatattgtggcagctccaggtcgcccaggcccgggaccccttacgtttcgacgtacgtc

SEQ ID NO: 533110 - DNA, 506 bp, Homo sapiens
  misc_feature: HEFZJCU01ED5O0.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttggaccacgtggggccagggaaccctggtcaccgtctcttcagcctccaccagggcccatcggtcttcccctggcaccctcctccaagagcacctctgggggcacagcggcccgtggctgctggtcaaggactacttccgtactagacg

SEQ ID NO: 533111 - DNA, 518 bp, Homo sapiens
  misc_feature: HEFZJCU01EHS15.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaagggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcacctggtcactgtctcctcgcttcaccaagggccatcggtcttcccctggcgccctcgctccacggagcacctcgtcgggggtcgacgagccggtccc

SEQ ID NO: 533112 - DNA, 537 bp, Homo sapiens
  misc_feature: HEFZJCU01ADJYQ.17.28.C06.1.454.heavy.3.raw
cgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattgggggccagggacgccctggtctacc

SEQ ID NO: 533113 - DNA, 530 bp, Homo sapiens; identical to SEQ ID NO: 448616
  misc_feature: HEFZJCU01BG3SV.18.33.C11.1.454.heavy.3.raw

SEQ ID NO: 533114 - DNA, 518 bp, Homo sapiens
  misc_feature: HEFZJCU01BXVS1.12.25.C03.1.454.heavy.3.raw
  modified_base (429)..(429): a, c, t, g, unknown or other
atacgacgtacacgaccggtgctcgatttagtagtgtagattttggtttggggacccaaaaaccgacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgagggcttctggttacacctttctcaggtatactattgcctgggtgcgacaggcccctggacaagggcttgagtggatggggtggatcaacgtacagactggtggcacagactatgcacaggggctccagggcagactcaccatgacccacagacacatcagcgaacacagtcaacatggagttgcggagcctgcganctgacgacgcggccgtatattactgtgcgagagtacgtagcggctcgttcctttgctactggggcctgggaactctggtcaccgtctcc

SEQ ID NO: 533115 - DNA, 511 bp, Homo sapiens
  misc_feature: HEFZJCU01BZVG3.3.35.D02.1.454.heavy.3.raw
  modified_base (496)..(496): a, c, t, g, unknown or other
agacgcactccacgaccggtgctcgatttagcacacgatagttgggtttggggctggtggcagctcccagatgggtcctgtcccaggtgcagctgcaggagtcgggcccaggactggtgaagccttcggagaccctgtccctcacctgcagtgtctctggctcctccatcagcagcggttactactggggctggatccggcagcccccagggaagggtctggagtggattgggagaatctatcatcttgggacgacctcctacaacccgtccctcaagagtcgagtcatcatatccctagacacgaccaagaaccagttctccctgaacctgagctctgtgaccgccgcagacacggccatgtattactgtgcgagggcatataactatggttattccgatgcttttgatgtctggggccaagggacagtggtcaccgtctcttcagcctccaccaacgggcccatcggtcttcccctggccacctcctccaagancacctcgtggggcac

SEQ ID NO: 533116 - DNA, 508 bp, Homo sapiens
  misc_feature: HEFZJCU01B8H96.48.34.D01.1.454.heavy.3.raw
  modified_base (469)..(469): a, c, t, g, unknown or other
agtatacatacacgaccggtgctcgatttagatcgtctgtgttgggtttggggtctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactcgtgagggccgattcgccttctccagagacaattccaagagctacggttcatctgcaaatgagcgcctgagacctgacgacacggctgtctattactgngacgagaggcgtccgagtttaacacgccggtcgggaggt

SEQ ID NO: 533117 - DNA, 551 bp, Homo sapiens
  misc_feature: HEFZJCU01D6PW0.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtcccgccaggctccaggcaaggggctcgagtgggtggcacttattgcacatgatggcgtcaacaaattcgtacgcaaattccgtgagggccgattcaccatctccagagacaattacaagaacaccctttatctgcaaatagacacgcctgagaccagacgacacggctcgtcttattattgcgcgagagagacacacgaacctactcggccaatactagtggggcgttgttcgtggggccgacggggacccgtggtcgtatccgtcctccccgacgtccctccacccgaacgggccctacgtccggtccttcccccgtcggccg

SEQ ID NO: 533118 - DNA, 514 bp, Homo sapiens
  misc_feature: HEFZJCU01BA3V4.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactcgtatctgcaaatgaacagcctgagagccgacgacacggccatatattactgtgacgaaagcaccggcagttagtcacccatactactttgactacctggggaccg

SEQ ID NO: 533119 - DNA, 475 bp, Homo sapiens
  misc_feature: HEFZJCU01EMUAW.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccactcagtcagctggttcgacccctggggccagggaaccctggtcaccgtctcctcagcctccaccaagggcccatcggtcttcccctggcaccctcctccaagagcacctctgggggcacagcggcctcgggctgcctggtcaaggactacttccgagtagtaca

SEQ ID NO: 533120 - DNA, 497 bp, Homo sapiens
  misc_feature: HEFZJCU01C1CX9.51.34.D01.1.454.heavy.3.raw
cgatcgtatacacgaccggtgctcgatttagatcgtctgtgttgggtttggggactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttctttttactgttgcgccaggaagcagtggcgtggccacatcatgtcttttgta

SEQ ID NO: 533121 - DNA, 514 bp, Homo sapiens
  misc_feature: HEFZJCU01BHVHM.4.57.F02.1.454.heavy.3.raw
  modified_base (449)..(449): a, c, t, g, unknown or other
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaactctacagatgaacagtctgagagccgaggacacggctgtctattattgtgcgagagtaagtggtcatggtccttttgaccagtggggcagggaacccctggtcaccgtctcctcagcttcnccaagggcccatcggtcttccccgtgcgccctgctccaggagcacctctggggcacgagcggccg

SEQ ID NO: 533122 - DNA, 534 bp, Homo sapiens
  misc_feature: HEFZJCU01ALQE4.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaaccgccaagaattcactgtatctacaactgaacagcctgagagtcgcagacacggccgtgtattactgtgcgagatgtaggaaaagtaatggctgtgtttagttggggccagggacgccgtggtc

SEQ ID NO: 533123 - DNA, 503 bp, Homo sapiens
  misc_feature: HEFZJCU01DKK1F.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggccacacgctgtatctgacaaatgaacagcctgagagctgaggacacggctgtgtattactgtgacgaagtatttactatagaggtgacgtacgggggcgttcg

SEQ ID NO: 533124 - DNA, 508 bp, Homo sapiens
  misc_feature: HEFZJCU01CW1J8.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactcctgtatctgcaaatgaacagcctgagagctgaggacacggtccttgttattattgtgcaaaagactaccaaccccttacgttacg

SEQ ID NO: 533125 - DNA, 530 bp, Homo sapiens
  misc_feature: HEFZJCU01DDWL6.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgaccagtgagttatatgaccgccgcagacacggccgtgtattactgtgcgacgagaggcccgttattttacggaccagctgttaaaaacctccttaactacggttctggacgtcgtggggccacggggacctaac

SEQ ID NO: 533126 - DNA, 502 bp, Homo sapiens
  misc_feature: HEFZJCU01DYZTM.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccggggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggcccgtgggctgcctggtcaaggactacttccagacgtatca

SEQ ID NO: 533127 - DNA, 495 bp, Homo sapiens
  misc_feature: HEFZJCU01DPZZ0.51.71.G05.1.454.heavy.3.raw
cgatcgtatacacgaccggtgctcgatttagtgtcgtcgcaagagagagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctcatgaccagaaatacgtccgcgagggacagtctacatggagttgagcagcctgagaactgacgacacggccatatattactgtgcgagagaccttgctggttccttttgacttcgtcggggcc

SEQ ID NO: 533128 - DNA, 417 bp, Homo sapiens
  misc_feature: HEFZJCU01CTX0I.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggccccctggacagggggtttgagtggatggggtggatcaaccctaccagaggtggcacaaagtatcgacagaactttcagggcagggtcaccatgacctggggacgcgtccatcagcacagtctacatggat

SEQ ID NO: 533129 - DNA, 526 bp, Homo sapiens
  misc_feature: HEFZJCU01B3BN6.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcgacaaattaacgaacacagttaatctgagctgaacagcctgtcatctgaggacacggcttctacttctgtgcgagagtaattactataacactgctccttttacacctccctagtacttcgtgggccatcggacccggtaccg

SEQ ID NO: 533130 - DNA, 510 bp, Homo sapiens
  misc_feature: HEFZJCU01DLBL7.51.82.H05.1.454.heavy.3.raw
cgatcgtatacacgaccggtgctcgatttagtcgagctctctcgcgggggctctgggagaggagcccagccctagaagtcggcggtgtttccattcggtgatcagcactgaacacagaggactcaccatggagtttgggctgagctgggttttcctcgttgctcttttaagaggtgtccagtgtcaagtgcaactggtggagtctgggggaggcgtggtccaggcctgggaggtccctgagactctcctgcgtggcctctggattcaccttcaatagttatggcatgctctgggtccgccaggccccaggcagggggctggactgggtagcatctatatcgtacgatggagctgacgaattacctcgcagactccgtgaagggccgattcaccatctcaagagacaattccaagaacaccctgtttctgcaaatgaacagcctgagacctgcggacacggctatgtatttctgtgcgaaggttactgggacctactctggtcccgcacgt

SEQ ID NO: 533131 - DNA, 490 bp, Homo sapiens; identical to SEQ ID NO: 449137
  misc_feature: HEFZJCU01AT1PO.11.26.C04.1.454.heavy.3.raw

SEQ ID NO: 533132 - DNA, 501 bp, Homo sapiens
  misc_feature: HEFZJCU01BIZWK.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagttttgggctgagttgggttttcctcgttgctcttttaagaggtgtccactgtcagctgcttctagttgagtcgggggagcgtggcccagcctgggagtccctcagactctcctgtgcagcgtctggattcagtttcgctacacatggcatgcactgggtccgccagtctccaggcaaggggctgcagtgggtgcgtttattcgaagcgatgggactcatgaacaatatgcagactccgtgaagggccgattcatcatctccagagacaactccaacaacacactggatctccaaatgaacagcctgagagtcgaggacacgggcccgtatacttagttgttcgtccctttggatttacctattggta

SEQ ID NO: 533133 - DNA, 508 bp, Homo sapiens
  misc_feature: HEFZJCU01CHLC2.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctagacgacacgggccgtctaattactgtgcgagaattgttttctgtcatcgtaactaatttgataggctctatggactggacttcgtc

SEQ ID NO: 533134 - DNA, 495 bp, Homo sapiens
  misc_feature: HEFZJCU01CPL9I.11.71.G05.1.454.heavy.3.raw
  modified_base (469)..(469): a, c, t, g, unknown or other
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatagatggaaatagtgacttctattcagactccgtgaagggccgattcaccgtctccagagacaattccaggcacacgctgtatctgcaaatgaacagcctgagagctgaggacacggctgtntagttactgtgcgaaagatttctata

SEQ ID NO: 533135 - DNA, 504 bp, Homo sapiens
  misc_feature: HEFZJCU01AUB7N.13.87.H10.1.454.heavy.3.raw
  modified_base (439)..(439): a, c, t, g, unknown or other
  modified_base (488)..(488): a, c, t, g, unknown or other
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgagggccgattcaccatcctccagagacaacgccaagaactccctgtatctgcaaatnaacagcctgagagctgaggacacggccttgtattattgtgacaaaaganaccaaccccttacgtt

SEQ ID NO: 533136 - DNA, 404 bp, Homo sapiens
  misc_feature: HEFZJCU01BK0HA.14.60.F05.1.454.heavy.3.raw
cgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccggtcttacgataattttgactggtcggcggggttcgacccctggggccagggaaccctggtcaccgtctcctcagcttccaccaagggcccatcggtcttccccctggcgccctgctccaggagcacctctgggggcacagcggccctgggctgcctggtcaaggactacttccgtactagacg

SEQ ID NO: 533137 - DNA, 530 bp, Homo sapiens
  misc_feature: HEFZJCU01A7E3C.47.6.A06.1.454.heavy.3.raw
  modified_base (440)..(440): a, c, t, g, unknown or other
  modified_base (498)..(498): a, c, t, g, unknown or other
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaaccctccctcaagagtcgagtcaccatatcaatagacacgtcgaagaaccagttctccctgagttgaactcagtgaccgctgcggacacggccgtgtattactgtgcgngccacaccgattacgattttggagtggccttgataactggggtccgacgggtagtccncggtcaccgtctccgtctacgcctcgaccaac

SEQ ID NO: 533138 - DNA, 502 bp, Homo sapiens
  misc_feature: HEFZJCU01CV6KJ.51.56.F01.1.454.heavy.3.raw
  modified_base (428)..(428): a, c, t, g, unknown or other
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgaggtggatgggatggtttagtctgagaactggtgccgcaaattatgcacaggagtttcggggcagggtcgtcatgaccggggacacgtccatcgccacgacttacatggaactgaccngtactgacatttgacgacacggccgtctattactgtgcgacagaagcggcggacagaggttcgcttactggtcg

SEQ ID NO: 533139 - DNA, 504 bp, Homo sapiens
  misc_feature: HEFZJCU01CEUMK.10.23.C01.1.454.heavy.3.raw
  modified_base (368)..(368): a, c, t, g, unknown or other
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaaggcctggagtgggtctcaggtattgattggaatagtggtaccattgcctntgcggactctgtgaagggccgattcaccatcaccagagacgacgccaggagctccctgtatctccaaatgaacagtctgagacctgaggacacggccttgtattactgtgtaaggaggagtctagggtttctaaac

SEQ ID NO: 533140 - DNA, 533 bp, Homo sapiens
  misc_feature: HEFZJCU01DVQTI.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtggtggccacataagcaagatggaactgccgagttttacgtggactctgtgaagggccgtttcaccatctccagagacaacgccaagaattcactgtatctacaactgaacagcctgagagtcgcagacacgggccgtgtattactgtgcgagatgtggaaaagtaatggctgtgtttattggggcaggggagccctggtctaccg

SEQ ID NO: 533141 - DNA, 500 bp, Homo sapiens
  misc_feature: HEFZJCU01EM0OA.10.26.C04.1.454.heavy.3.raw
catagtagtgcacgaccggtgctcgatttagtctagcgactttgggtttggggggaaaaggaagactgacggtcccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaa

SEQ ID NO: 533142 - DNA, 525 bp, Homo sapiens
  misc_feature: HEFZJCU01BO3NW.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagcctacatggaactcaacggcctcagatttgaggacacggccgtctattattagtgcgagagtagagaaattacggtggctactcccttgactactggggaccagggaaccctggctaccg

SEQ ID NO: 533143 - DNA, 478 bp, Homo sapiens
  misc_feature: HEFZJCU01EAUVF.19.71.G05.1.454.heavy.3.raw
  modified_base (201)..(201): a, c, t, g, unknown or other
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctcgcagaccctctcgctcaccctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaaagaaccagttactccctgcagctgacctctgtgacctcccggaggaccacgggtgtatattactagtggaaga

SEQ ID NO: 533144 - DNA, 518 bp, Homo sapiens
  misc_feature: HEFZJCU01EWINT.2.85.H08.1.454.heavy.3.raw
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggcttgagtggctgggggggatcatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgattatttgtaatttcgactcctaccactacggtatggacgtctggggccaggggaccacggcaccgtctcttc

SEQ ID NO: 533145 - DNA, 534 bp, Homo sapiens
  misc_feature: HEFZJCU01DXHCH.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactccctgtacagcctctggattcactttcagtaaggcctggatgaactgggtccaccaggctccagggaaggggctggagtgggttggccgtattaaaaccaaaactgatggtgggacaacagactacgctgcaccgtgaaaggcagattcaccatctcaagagatgattcaaaagcacgctgtatctgcaaatgaacagcctgagaaccgaggacacagccgtgtattactgtaccacactcccctgaaagcgtacaactactactactacggtatggtacctcgg

SEQ ID NO: 533146 - DNA, 526 bp, Homo sapiens
  misc_feature: HEFZJCU01ES0N8.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccaggtaaggggctggagttgggtttcatacatttatcctagtggtgataccatatactacgcagactctgtgaagggccgattcaccatctccagggacaacgccaagaactcactgactttgcaatgaacaccctagcgagccgaggacacggccgtatattactgtgcgagaataacccgttcgtcctggttacttttaccg

SEQ ID NO: 533147 - DNA, 525 bp, Homo sapiens
  misc_feature: HEFZJCU01D6X9S.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcgggggacctcgaccctggttctacgttcgatctctggggcc

SEQ ID NO: 533148 - DNA, 527 bp, Homo sapiens; identical to SEQ ID NO: 481767
  misc_feature: HEFZJCU01BIGMO.12.40.D07.1.454.heavy.3.raw

SEQ ID NO: 533149 - DNA, 502 bp, Homo sapiens
  misc_feature: HEFZJCU01CSIDB.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccagggacaatggtcaccgt

SEQ ID NO: 533150 - DNA, 502 bp, Homo sapiens
  misc_feature: HEFZJCU01CZDZU.51.78.H01.1.454.heavy.3.raw
cgatcgtatacacgaccggtgctcgatttagtgtgagtagtttgggtttggggctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggagcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttagtattactgcgcaaaagccaaggcaacagctggtacta

SEQ ID NO: 533151 - DNA, 524 bp, Homo sapiens
  misc_feature: HEFZJCU01CZL4L.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgtagagccgaaggacacggctgtgtattattgtgtcgag

SEQ ID NO: 533152 - DNA, 511 bp, Homo sapiens
  misc_feature: HEFZJCU01DZ52T.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagacgcacctctgggggcacagcggccctgggctgcctggtcaggactacttccgagtgcgtct

SEQ ID NO: 533153 - DNA, 511 bp, Homo sapiens
  misc_feature: HEFZJCU01BQKTJ.48.23.C01.1.454.heavy.3.raw
  modified_base (477)..(477): a, c, t, g, unknown or other
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccatccctcaaaagtcgaggcaccatatccgtagacacgtccaagaaccaattctccctgaagctgagctctgtgaccgccgcagacacggctgtctattactgtgcgaggccccgagcgcagtggtcgttttgtatgtcctttgntatgtgggtccgaagggacgaatcggtcgtaccg

SEQ ID NO: 533154 - DNA, 525 bp, Homo sapiens
  misc_feature: HEFZJCU01C5NK0.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattaggaaccaaacctgaacaagtacgcgacaatttatgctgcgtcggtgcaaggcaggttcaccatctccagagatgattcagaagaacacggcgtatctgcaaatgaacagcctagaaaaccgaggacgaccggccggtgttattacgttcgtgccgagaccatccggtacgtattacgtatttttt

SEQ ID NO: 533155 - DNA, 501 bp, Homo sapiens
  misc_feature: HEFZJCU01BUB5A.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctggtgtattactgtgcgtaaagatttctatagaggtgacgtac

SEQ ID NO: 533156 - DNA, 490 bp, Homo sapiens
  misc_feature: HEFZJCU01BK49Z.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcacggggtccctcccgacactcggtttta

SEQ ID NO: 533157 - DNA, 556 bp, Homo sapiens
  misc_feature: HEFZJCU01DBANX.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagtacgtgaggacacgggctgtctattactgtgcgactgagatgtcttattacgatgccagtgctttagtaccgtttcgtacccctggggccagggagcccgtggtcaccgtctccttcacgcttccacctaaacggggaccccgaatccggtcgttttccccccgtcgggtccggccccgtcggtcctccgacggacggaccgtacccg

SEQ ID NO: 533158 - DNA, 559 bp, Homo sapiens
  misc_feature: HEFZJCU01ENRKA.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagtctgagaaccgaggacacagccgtgtattactgtaccactatcccctagaaacgcggtacaaactactaactacgtaacggtactcggaccgtcttgggggccaacggggacccg

SEQ ID NO: 533159 - DNA, 400 bp, Homo sapiens
  misc_feature: HEFZJCU01BRKMH.47.58.F03.1.454.heavy.3.raw
agctcacgtacacgaccggtgctcgatttagtctgatcgagaagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 533160 - DNA, 554 bp, Homo sapiens
  misc_feature: HEFZJCU01AEV5A.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctggtgaagggccgattcaccgtctccagagaaaacgccaaagaacacggtgtatctgcaaatgactggcctgagagccgaggacacggctagttttattactgtgcaagaggtcttggtgggtcgacttggtaccgaccgtgggactgggttaccttcggattcgtgggttcggggggccgtgggaccaccccgtt

SEQ ID NO: 533161 - DNA, 527 bp, Homo sapiens
  misc_feature: HEFZJCU01BEZBN.7.71.G05.1.454.heavy.3.raw
  modified_base (321)..(321): a, c, t, g, unknown or other
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggnttgggagtgggtggcagtttgtttcatctgagggcagtgttcaatggtatgcagactccgtgaagggccgattcaccatctccagagacaattccaggaacacaatgtatttaggaaatgaacagcctaagtcctgaggacgacgggtagtatactactgtacgaagggaggggggaaccgaggcgggagtccaagtacgttaccg

SEQ ID NO: 533162 - DNA, 500 bp, Homo sapiens
  misc_feature: HEFZJCU01DMIX8.3.20.B09.1.454.heavy.3.raw
  modified_base (439)..(439): a, c, t, g, unknown or other
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgngactggccgcaacagactacggtggcaactcctatgcttttgatatctggggccaagggac

SEQ ID NO: 533163 - DNA, 520 bp, Homo sapiens
  misc_feature: HEFZJCU01CPWJV.48.45.E01.1.454.heavy.3.raw
agtatacatacacgaccggtgctcgatttagtgagtcagtaagggaaaggggacccaacaaccacacccctcctaagaagaagcccctagaccacagctccacaccatggactggacctggaggatcctcttcttggtggcaggcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtgggatcgaacaccaacactgggaacccaacgtatgcccagggcttcacaggacgatttgtcttctccttggacacctctgtcaatacggcacatctgcagatcaccagcctgaagactgaggacactgccgtgtattcttgtgtgagacgaagtagtagctcgccctcctttgactactggggccaggggaaccctgggtcaccgcct

SEQ ID NO: 533164 - DNA, 536 bp, Homo sapiens; identical to SEQ ID NO: 472290
  misc_feature: HEFZJCU01ANNVU.17.28.C06.1.454.heavy.3.raw

SEQ ID NO: 533165 - DNA, 390 bp, Homo sapiens; identical to SEQ ID NO: 444541
  misc_feature: HEFZJCU01DRKS0.16.24.C02.1.454.heavy.3.raw

SEQ ID NO: 533166 - DNA, 521 bp, Homo sapiens
  misc_feature: HEFZJCU01AZUHK.16.67.G01.1.454.heavy.3.raw
tgtactactccacgaccggtgctcgatttagagtatacatattgggtttggggagctctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtctgggggaggcttggtacagcctggggggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattacttgtcgcgaaagatcgacttccccctcgtagagatggtactactaaa

SEQ ID NO: 533167 - DNA, 505 bp, Homo sapiens
  misc_feature: HEFZJCU01ER06U.10.55.E11.1.454.heavy.3.raw
catagtagtgcacgaccggtgctcgatttagcactcgcacgttgggtttgggctcaactctcttgtccaccttggtgttactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaaagaaggtggctacaatcacggagtcttttgtaagttttggggccgaagggacaatggtcatcgtctcctcacg

SEQ ID NO: 533168 - DNA, 520 bp, Homo sapiens
  misc_feature: HEFZJCU01DRMPP.16.10.A10.1.454.heavy.3.raw
  modified_base (445)..(445): a, c, t, g, unknown or other
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttccgacccctggggccagggaaccctggtcaccgtctcctcagcctccaccaagggcccatcggtcttcccctggcnccctcctccaagagcacctctgggggcacagcggccctgggctgcctggtcaaggactacttccgagtagtacac

SEQ ID NO: 533169 - DNA, 533 bp, Homo sapiens
  misc_feature: HEFZJCU01AYJGB.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtggtattactgtgcgagagagtggggcccacgacgttactacgctatggacgtcgtggggtccgaagggaccgtacc

SEQ ID NO: 533170 - DNA, 506 bp, Homo sapiens
  misc_feature: HEFZJCU01D5OCV.18.50.E06.1.454.heavy.3.raw
  modified_base (432)..(432): a, c, t, g, unknown or other
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttattacagtggcggcactacatactacacagacttcgcgaggggccgattcaccatctccagagacgattccaagaacacgttgtatcttcaatgaanagctgacagtcgacgacacggccatgtatttttgtgtcgagcgacccggggactcctcaatggctttcattacg

SEQ ID NO: 533171 - DNA, 483 bp, Homo sapiens; identical to SEQ ID NO: 447485
  misc_feature: HEFZJCU01EUI9P.40.71.G05.1.454.heavy.3.raw

SEQ ID NO: 533172 - DNA, 500 bp, Homo sapiens
  misc_feature: HEFZJCU01D03K0.48.81.H04.1.454.heavy.3.raw
  modified_base (473)..(473): a, c, t, g, unknown or other
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagaccgtagaggacacggccatttactactgtgcgcggggaggtggacggngctcggtttcggagtttatcatctact

SEQ ID NO: 533173 - DNA, 385 bp, Homo sapiens; identical to SEQ ID NO: 448034
  misc_feature: HEFZJCU01EWH46.13.24.C02.1.454.heavy.3.raw

SEQ ID NO: 533174 - DNA, 536 bp, Homo sapiens
  misc_feature: HEFZJCU01ENHG3.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccgagggaaccctggtccaccgtctcctcagcctccaccaacggcc

SEQ ID NO: 533175 - DNA, 489 bp, Homo sapiens
  misc_feature: HEFZJCU01EDKWW.40.71.G05.1.454.heavy.3.raw
  modified_base (419)..(419): a, c, t, g, unknown or other
tctagcgactcacgaccggtgctcgatttagtgtcgtcgcaagagagaggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacaggagtcaccaatcgaccacagacacatccaccagcacagcctatatggaggtgaggngacctgacatctagacgacacggccgtatattactgtgcgagagatcatcggaggtggaatggccgtggt

SEQ ID NO: 533176 - DNA, 524 bp, Homo sapiens
  misc_feature: HEFZJCU01D9781.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggttgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggggtccgccaggctccagggaaggggctggagtgcgtctcttttatttatagtagtggtagtacatactccgcagactccgtgagggccgattcacatctccagagacaattccaagaacacgctgtttcttctaaatgaacagcctgagagccgatgacacggccgtgtattactgtgcgagagatggggcccacgaacgttactacgctatggacgtctggggaccgaagggaccgac

SEQ ID NO: 533177 - DNA, 526 bp, Homo sapiens
  misc_feature: HEFZJCU01DTDMH.14.25.C03.1.454.heavy.3.raw
cgtctagtaccacgaccggtgctcgatttagtagtgtagatttgggtttgggtgcccaagctgctggagggcacggtcaccacgctgctgagggagtagagtcctgaggactgtaggacagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccccgtcgggggccgacggggaacccgtacggtcacccgttcctcccttccacgccctcccacccgaaacggggccccaacgtccggtcctttcccccgtcgg

SEQ ID NO: 533178 - DNA, 538 bp, Homo sapiens
  misc_feature: HEFZJCU01ECXK2.17.28.C06.1.454.heavy.3.raw
cgtagactagcacgaccggtgctcgatttagagctcacgtattgggtttggggaggtctcagagaggaggcttagccctggactcccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgcgagttttacgtggactctgtgaagggccgtttcaccatctccagagacaacgccaagaattcactgtatctacaacctgaacagcctgagagtcgcagacacggccgtgtattactgtgcgagatgtagaaaagtaatggctgtgtttagttggggccagggacgccctggtcacccg

SEQ ID NO: 533179 - DNA, 528 bp, Homo sapiens
  misc_feature: HEFZJCU01BZOXS.51.62.F07.1.454.heavy.3.raw
  modified_base (460)..(460): a, c, t, g, unknown or other
cgatcgtatacacgaccggtgctcgatttagtagtcgcataaagggaaaggggacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacacgcctacatggaactcaacggcctcagatttgaggacacggccgtctattattgtgcgagngtgagaattacggtggctacttcccttgactactggggccagggaaccctggtacaccgtctcctacg

SEQ ID NO: 533180 - DNA, 522 bp, Homo sapiens
  misc_feature: HEFZJCU01B4BKT.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactcgcccggtcctgcacctcgtgtcggccctaagtttcggtttaccggtctaccacaaaatcgagggcgaacgtcctacgaccggtctcggac

SEQ ID NO: 533181 - DNA, 553 bp, Homo sapiens
  misc_feature: HEFZJCU01EZ6OT.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacagccgggggggtccctgagactctcctgtgcagcctctggattcaatttaacagctttgccatgggctggggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattacctgtgcgaaggatcgcccctataagtggtggttggagtcggggtagtttggttccgtggggccgagggaacccgtgggtctacccg

SEQ ID NO: 533182 - DNA, 504 bp, Homo sapiens
  misc_feature: HEFZJCU01CH42W.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtcggctagtcacctggtagtttg

SEQ ID NO: 533183 - DNA, 487 bp, Homo sapiens
  misc_feature: HEFZJCU01EM727.40.71.G05.1.454.heavy.3.raw
  modified_base (464)..(464): a, c, t, g, unknown or other
tctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatccaccagcacagcctatatggaggtgaggagccgtgacatctgacgacacggccgtatacttactgtgcgagagatnagtcggaggtggaatggccgtgt

SEQ ID NO: 533184 - DNA, 483 bp, Homo sapiens
  misc_feature: HEFZJCU01D30RJ.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattatgtaccactaagagtcccacgaagactgtgggaagggactgctggggccagggagcccttgtcaccgtctcctcagcctccaccaagggcccatcggtcttcccctggcgccctgctccaggagcacctccgacgagcacagcggccctgggctgcctggtcaaggactacttcccactactatg

SEQ ID NO: 533185 - DNA, 482 bp, Homo sapiens
  misc_feature: HEFZJCU01B28DS.17.28.C06.1.454.heavy.3.raw
cgtagactagcacgaccggtgctcgatttagagctcacgtattgggtttggggaggtctcagagaggaggcttagccctggactccaaggcctttccacgttggtgatcagcactgagcacagaggactcaaccatggagttggggctgaactgggttttccttgttgctgttttagaaggtgtccagtgtgaggtccaggttggttgagtccgggggaggcctggtccagcctggggggtccctgagactctcctgtgcagcctccggattcccctcagtagttacttggatgacttgggtccgccagactccagggaaggggctggagtgggtggccaacataaagcaagataggaactgccgagttttacgtggactctgtgaagggtccgtttcaccatctccgagagacaacgcccaagaattcactgtatctaacaactgaacagcctgagatcgcagacacggccgtgtatactg

SEQ ID NO: 533186 - DNA, 505 bp, Homo sapiens
  misc_feature: HEFZJCU01C1FW6.48.37.D04.1.454.heavy.3.raw
agtatacatacacgaccggtgctcgatttagtagcatactgttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgagggacacggctgtttattactgtgcgagagtgcggtatttcacctacacg

SEQ ID NO: 533187 - DNA, 517 bp, Homo sapiens
  misc_feature: HEFZJCU01CVW2D.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaaccgttactacgctatggacgtcgtggggaccg

SEQ ID NO: 533188 - DNA, 524 bp, Homo sapiens; identical to SEQ ID NO: 462117
  misc_feature: HEFZJCU01A8QXF.12.40.D07.1.454.heavy.3.raw

SEQ ID NO: 533189 - DNA, 513 bp, Homo sapiens
  misc_feature: HEFZJCU01AF0UO.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgacgtacgggaaagcttttagatctcgtggggccaagggacacgtggtcaccgtctcttcagccctctaccgaacggccagtccggtcctttccccgtggccgcctcgcctcg

SEQ ID NO: 533190 - DNA, 392 bp, Homo sapiens
  misc_feature: HEFZJCU01DDJUJ.13.86.H09.1.454.heavy.3.raw
tcacgtactacacgaccggtgctcgatttagtgctatagacttgggtttgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactattacatggacgtctggggcaaagggacgacggtcaccgtttcgccagcctccaccaagggcccatcggtcttccccctggcacccgtcctccaagagcacctctgggggcacagcggccctgggctgcctggtcaaggactacttcctagtacgtga

SEQ ID NO: 533191 - DNA, 411 bp, Homo sapiens
  misc_feature: HEFZJCU01C1MXF.16.29.C07.1.454.heavy.3.raw
tgtactactccacgaccggtgctcgatttagagtgctacgaagggaaaggggctggagtgggtctcagctattagtattagtggtgatagcacatactacgcagactccgtgaagggccggttcaccatctccagagacaattccaagaacacggtgaatcttcaaatgaacagcctgagaaccgaggacacggccatatattactgtgcgaaagatcgattccccctccgtagagatggctacaaaatctttctccgaattgacttctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 533192 - DNA, 495 bp, Homo sapiens
  misc_feature: HEFZJCU01BVVAT.19.13.B02.1.454.heavy.3.raw
  modified_base (472)..(472): a, c, t, g, unknown or other
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggccaaggggctgggagtgggtggcagttatatcatatgatggaagtaataaatactatgcagactccgtgaagggccgattcaccatctccagagacaattccaagaacacgctgtatctgcaaatagaacacgcctgagagctggaggacacggctcggtnttattactgtgcggagggtcggt

SEQ ID NO: 533193 - DNA, 317 bp, Homo sapiens
  misc_feature: HEFZJCU01BP4LJ.22.11.A11.1.454.heavy.3.raw
acatacgcgtcacgaccggtgctcgatttagctacgactgcagggggggagagggagcccagcacgtgggacttccgaggtgtttccagtttccggtgattcagcactgaacacagaggactcaccatgggagttttggctgagctcgggttttccttgttggctatttctaaaaggtgttccagtgtgaggtcgcagctggtggagacgtggaggagtccttggatccgacgcctgggggggtcccctggagactctcctgtgcagcctcttgggttcaccgtcagtacgcaaggttacactgaggcttggggtcc

SEQ ID NO: 533194 - DNA, 515 bp, Homo sapiens
  misc_feature: HEFZJCU01EF1OC.9.12.B01.1.454.heavy.3.raw
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaagggggctggagtgggtctcagttatttatagcggtggtaacacatactacgcagactccgtgaagggcagattcaccatctccagagacaattccaggaacacgctgtatcttcaaatgaacagcctgagagtcgaggacgacggctgtatattactgtgcgagagatgtgtacgcttttgatatctggggccaagggaacg

SEQ ID NO: 533195 - DNA, 523 bp, Homo sapiens
  misc_feature: HEFZJCU01C3KLA.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggctacagcggccctgggctggcctggtcaaggactaccttcctagtagacacg

SEQ ID NO: 533196 - DNA, 499 bp, Homo sapiens
  misc_feature: HEFZJCU01EGMGG.53.81.H04.1.454.heavy.3.raw
cgcgtatacacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaatgaacagcctgagagctgaggacacggctctttattacttgtgcgagagattctggatacagccattta

SEQ ID NO: 533197 - DNA, 533 bp, Homo sapiens
  misc_feature: HEFZJCU01CG3W4.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacattcttcactacttattctgtcaattgggtccgacaggcccctggacaaggccttgactacatgggatggatcaacaccgacactgggaaccccacctatgcccaggccttcacagggcggtttgtctttctccatggatacctctgtcgggacggcttatctgcagataaccaaccttcaacctgacgacactgccgtttatttttgtacgagaggcgtcgtctgtcagtggaattgactactggggccgagggaaccgtacggtcaccgtctcctcagcctccacc

SEQ ID NO: 533198 - DNA, 537 bp, Homo sapiens
  misc_feature: HEFZJCU01DG2Z0.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctgggggcccgggaacccgtggtccaccgtctcctcagcctccaccaagggcccatcggtcttcccctc

SEQ ID NO: 533199 - DNA, 540 bp, Homo sapiens
  misc_feature: HEFZJCU01BLPF4.17.28.C06.1.454.heavy.3.raw
  modified_base (407)..(407): a, c, t, g, unknown or other
  modified_base (489)..(489): a, c, t, g, unknown or other
  modified_base (526)..(526): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttccagtagttattggatgacttgggtccgccagactccagggaaggggctggagtgggtggccaacataaagcaagatggaactgccgagttttacgtggactctgtgaagggccgtttcaccatctccagngacaacgccaagaattcactgtatctacaactgaacagccctgagagtcgcagacacggccgtgtattactgtgcgagatgnggaaaaagtaatggctgtgtttatggggccagggganccctggtactcccg

SEQ ID NO: 533200 - DNA, 537 bp, Homo sapiens
  misc_feature: HEFZJCU01BALAG.49.12.B01.1.454.heavy.3.raw
agtcgagagacacgaccggtgctcgatttagtagtgtagattccgcgggcacgaccggtgctcgatttagtagtgtagattccgcgggggagagaggagcccagccctgggattttcaggtgttttcatgtggtgatcaggactgaacagagagaactcaccatggagtctgggctgacgtggctttttcttgtggctattttaaaaggtgtccagtgtgacgtgcaactggtggagtctgggggaggcttggtacagccgggggggtccctgagactctcctgtacagcctctggcttcacctttagagtctatgacatgagttgggtccgccaggctccggggaaggggctggagtgggtctcaacgatcagtgaaagtggaagtaccacaaagtacgccgactccgtgaagggccggtgcaccatctccagagacaattcgaaggacactttatatctgcaactcaacagactgacaaccgcggacacggccgtctattactgtgtgaaagagacggaccgctggacgaggacg

SEQ ID NO: 533201 - DNA, 505 bp, Homo sapiens
  misc_feature: HEFZJCU01BV45N.48.34.D01.1.454.heavy.3.raw
  modified_base (441)..(441): a, c, t, g, unknown or other
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggancacctccgagagcacgagcggcccgtcgggctggcctggtcaaggactacttcctatgtatact

SEQ ID NO: 533202 - DNA, 490 bp, Homo sapiens
  misc_feature: HEFZJCU01CUBKA.19.59.F04.1.454.heavy.3.raw
tactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtacagcctctggattcaccttcagtagttatgaaatgaattgggtccgccaggctccagggaaggggctggagtgggtttcatacattagtagtagtggtagtagcatatactacgcagactctgtgaaggccgattcacatctccagagacagcgccaagactcactgtatctgcaaatgaacagcctgagagccgaggacacggcagttttattactgtgcgagagagtggc

SEQ ID NO: 533203 - DNA, 503 bp, Homo sapiens
  misc_feature: HEFZJCU01D9F59.17.10.A10.1.454.heavy.3.raw
  modified_base (470)..(470): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaatgacgagcctgagagctgacgacacggccgtcgtattactgtgcgagaatgttttctgtcatcgtanaatttgaataggctctatggactggacttcgtc

SEQ ID NO: 533204 - DNA, 547 bp, Homo sapiens
  misc_feature: HEFZJCU01DTXHN.47.78.H01.1.454.heavy.3.raw
  modified_base (496)..(496): a, c, t, g, unknown or other
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaagcagattcaccatctccagagatgattcaataatatgtcatatctactaaatggatagcctagtaaaatacggaaggatacgaggttacgtttattaactgttaccncgtaaggtaagtgcgggtttctcgtcgggggtccggaacgggggaacctaa

SEQ ID NO: 533205 - DNA, 548 bp, Homo sapiens
  misc_feature: HEFZJCU01CMEIB.51.75.G09.1.454.heavy.3.raw
  modified_base (391)..(391): a, c, t, g, unknown or other
  modified_base (410)..(410): a, c, t, g, unknown or other
cgatcgtatacacgaccggtgctcgatttagtatagacatcaggggaggctctgagagaggaggcccagccctgggattttcaggtgttttcatttggtgaccaggactgaacagagagaactcaccatggaggttgggctgagttggctttttcttgtggctattttaaaaggtgtccagtgtgaggtgcagttgttggagtctgggggaggcttggtacagcctggggggtccctgagactctcctgtgcagcctctggaatcacctttaggaattatgccatgacgtgggtccgccaggctccaggaagggctggagtgggtctcgactattagtggtagtggtggtaggacatactacgcaagactccgtcaagggccggttcaccntctaccagagacaatcganaactcggtgtctctgcaatgagcagcctgaggacgccggaggaccgaccgggcccgttaattactttccgtggttgaccgaaaaggtccttacgggaacctaacgtggtaacgtaacgttatcgttcgctagttcagg

SEQ ID NO: 533206 - DNA, 501 bp, Homo sapiens
  misc_feature: HEFZJCU01BLZJQ.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggccacacgctgtatctgcaaatgaacagcctgagagctggaggacacggctgtgtattactgtgcgaaagatttactatagaggtgagtacgggggcgttcg

SEQ ID NO: 533207 - DNA, 512 bp, Homo sapiens; identical to SEQ ID NO: 450914
  misc_feature: HEFZJCU01CKVT6.15.67.G01.1.454.heavy.3.raw

SEQ ID NO: 533208 - DNA, 495 bp, Homo sapiens; identical to SEQ ID NO: 445359
  misc_feature: HEFZJCU01EYI1E.4.21.B10.1.454.heavy.3.raw

SEQ ID NO: 533209 - DNA, 543 bp, Homo sapiens
  misc_feature: HEFZJCU01EOUXV.2.4.A04.1.454.heavy.3.raw
acgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtgcctccatcagcagtagtagttattactggggctggattcgccagcccccagggaaggggctggagtggattgggagtttctattatggtgggggaacctactacaacccgtccctcaagagtcgagtcaccgtatccttagacacgtccaagaaccaattctccctgaaactgaactctatgaccgccgcagacacggctgtttattattgtacgggccgtgtaacgttggactacgtggggccagggagccgtggtcgaccgtctcctcagcctccaccgaagggcccatcggtccttcccccgtggccaccctcctccaagacg

SEQ ID NO: 533210 - DNA, 506 bp, Homo sapiens
  misc_feature: HEFZJCU01D79QL.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattacgtcctactttgactactgggccagggaactcgtggtctaccgtctccgcagcctccacc

SEQ ID NO: 533211 - DNA, 543 bp, Homo sapiens
  misc_feature: HEFZJCU01CIOUS.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaagccaagaattcactgtatctacaactgaacagcctgagagtcgcagacacggccgtgtattactgtgcgagatgtggaaaaagtaatggctgtgtttattgggggtccaggggacgccctggtcctaacccg

SEQ ID NO: 533212 - DNA, 512 bp, Homo sapiens
  misc_feature: HEFZJCU01AWPP5.16.71.G05.1.454.heavy.3.raw
  modified_base (427)..(427): a, c, t, g, unknown or other
  modified_base (433)..(433): a, c, t, g, unknown or other
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtattctgcaaatgaacancctganagccgacgacacggccatatattactgtgcgaaagcaccggcagttagtcacccatactactttgactacgtgggccac

SEQ ID NO: 533213 - DNA, 496 bp, Homo sapiens
  misc_feature: HEFZJCU01C8PUP.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccggaggacacggccgtattattactgtgcgaaagtatttaggggaatgaccactc

SEQ ID NO: 533214 - DNA, 531 bp, Homo sapiens
  misc_feature: HEFZJCU01CWMAY.51.81.H04.1.454.heavy.3.raw
cgatcgtatacacgaccggtgctcgatttagtagtgtagattcgcggggggagagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgactattttgacgacgacggcccgtctattactgtgcggacaggaagcgggcggacgaggtagggtttcgctttactgggtttcggacgggtcgtcctcccccc

SEQ ID NO: 533215 - DNA, 516 bp, Homo sapiens
  misc_feature: HEFZJCU01ESWZL.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtcgtggggccaagggaccacggtcaccggtctcctcagccctccacccaaggggccccagtcc

SEQ ID NO: 533216 - DNA, 536 bp, Homo sapiens
  misc_feature: HEFZJCU01EK90C.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtggtattactgtgcgagatgtaggaaaaagtatggctgtgtttagttggggctagggagccctggtcaccgtcc

SEQ ID NO: 533217 - DNA, 516 bp, Homo sapiens
  misc_feature: HEFZJCU01DOKGX.8.37.D04.1.454.heavy.3.raw
ctcgcgtgtccacgaccggtgctcgatttagtagcatactgttgggtttggggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatgggagatgaggagccctgagacttgacgacacggccgtatattactgtgcgagaatcgaagaaggtggctacaatcacggagcttttgaattttggggccaagggacaatgtcatcgtctcctctagcctccaccaagggcccatcggtcttccccctggtcaccctcctccaagagcacctctgggggcacagcggccctgggctgtccg

SEQ ID NO: 533218 - DNA, 535 bp, Homo sapiens
  misc_feature: HEFZJCU01AUFRS.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctcgacgacactgtccgtttatttttgtacgagagcgtcgtctgtcagtggaattgactactggggcagggaacctggtcaccgtctcctcagcctccaccgaaggccc

SEQ ID NO: 533219 - DNA, 521 bp, Homo sapiens
  misc_feature: HEFZJCU01CXQ2K.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatcctccagagacaacgccaggaactccctctatctagaaatggacagtctgacaactgaggacacggtccttttattctgtgacaaaggtggaaccgacattatttcacaagctggccactggtaccttacg

SEQ ID NO: 533220 - DNA, 563 bp, Homo sapiens
  misc_feature: HEFZJCU01EA7BN.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaaggggcttgagtggatggggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagtattttagggacctcgggcccgttggggggagtttagtccgtttactttgtaccttacgtcgggggccgaacggggaacccgagggtaccacccggtctt

SEQ ID NO: 533221 - DNA, 490 bp, Homo sapiens
  misc_feature: HEFZJCU01B92XD.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctgtcaaggactacttcccacgagagta

SEQ ID NO: 533222 - DNA, 521 bp, Homo sapiens
  misc_feature: HEFZJCU01BU485.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggagctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttaagtgtatctgcaaatgagcagcctgagagccggaggacacggctgtgtattatgtgcgag

SEQ ID NO: 533223 - DNA, 493 bp, Homo sapiens
  misc_feature: HEFZJCU01BFFE2.52.19.B08.1.454.heavy.3.raw
cgcagtacgacacgaccggtgctcgatttagtgagtcagtaagggcacgaccggtgctcgatttagtgagtcagtaaggggggggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctggggaggtccctgagactctcttgtgctgcctctggattcaccttcagggtctatgacatgcactgggtccgccaggctccaggcaaggggctgggagtggggtggcattttatatcatatgatggaagcaagatatactatgtagactccgtgaagggccgagttcatcatctccagagacaactccgagaacacgctgtatctgcaatgactcaggctgagagctgaagacacggta

SEQ ID NO: 533224 - DNA, 536 bp, Homo sapiens
  misc_feature: HEFZJCU01BQAWQ.17.28.C06.1.454.heavy.3.raw
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctcagagacaacgccaagaattcactgtatctacaactgaacagcctgagagtcgcagacacggccgtgtattactgtgcgagatgtggaaaagtaatggctgtgtttatggggccaggggacncccgtggtctaccg

SEQ ID NO: 533225 - DNA, 532 bp, Homo sapiens
  misc_feature: HEFZJCU01EESJP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagccctccaccaaggggcccagtcggtcttccccctcggcgccctcg

SEQ ID NO: 533226 - DNA, 537 bp, Homo sapiens
  misc_feature: HEFZJCU01EJPVU.17.28.C06.1.454.heavy.3.raw
  modified_base (371)..(371): a, c, t, g, unknown or other
  modified_base (524)..(524): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatggtaggaaaaagtaatggctgtgtttattggggccagggngccctggtcaccg

SEQ ID NO: 533227 - DNA, 491 bp, Homo sapiens
  misc_feature: HEFZJCU01BXCZE.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgagggggccgattcaccatctccagacgacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaacggcccatcggtcttcccctggcgccctgctccaggacgcacctccgagagcacagcggcccgtgggctgcctggtcaaggactacttcctacgtgagct

SEQ ID NO: 533228 - DNA, 502 bp, Homo sapiens
  misc_feature: HEFZJCU01EGX19.40.81.H04.1.454.heavy.3.raw
  modified_base (472)..(472): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacgaaagtatcgacagaactttcagggcagggtcaccatgacctgggacgcgtccatcagcacagtctacatggatctgagcggactgacctctgacgacacggccatgtattactgtggaagagacgttggngctccggcgggctcgaccacgtggggaccg

SEQ ID NO: 533229 - DNA, 520 bp, Homo sapiens
  misc_feature: HEFZJCU01EGQ1T.48.81.H04.1.454.heavy.3.raw
agtatacatacacgaccggtgctcgatttagtagtgtagattcgcggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagtattccaggggcagaatcacacttaccgcggacaaatccacgggcacagcgcagttggacctgagcggcctggacgaaccgtcgaggaaccgacggcctacgttactactgtgcgcggggaggtggacggagcttcggttttcggagttatcactctactactta

SEQ ID NO: 533230 - DNA, 537 bp, Homo sapiens
  misc_feature: HEFZJCU01DD9FW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctacgtggccaatactatgggggcttgttctgggggccaggggaccctgggtcattcgtctaccccagccctccaccgaagggcccagtccggtcttccccgtgccgccctcg

SEQ ID NO: 533231 - DNA, 511 bp, Homo sapiens
  misc_feature: HEFZJCU01BROJ8.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggaccacgtccataagcacagtttacatggaggtaaataggctgagatctgacgacacggaccgtatattacgtagtgcgttattaacggacgtattacgtatgttttgtatttggtttttacg

SEQ ID NO: 533232 - DNA, 534 bp, Homo sapiens
  misc_feature: HEFZJCU01D4FGG.16.27.C05.1.454.heavy.3.raw
  modified_base (425)..(425): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctggggggaggcgttgtccagcctgggaggtcgttgagactctcctgtgaaggctctggattcacattcagtgactatggcatacactgggtccgccgaggctccaggcaaggggctgaagtgggtggcgtttatttcatatgatggaactactcaacactatccagactccggggagggccgattcaccgtctccagagacaattccaagacagggtgtttcnccaagtgattgatctgagaagtgaggacacggctgtttattactgtgcgcggtggctgacccgctcttagactacgtgggggccggggagccccggtcagtcgtctccg

SEQ ID NO: 533233 - DNA, 535 bp, Homo sapiens
  misc_feature: HEFZJCU01CW1R6.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgccgtttattttgtacgagagcgtcgtctgtcagtggaattgactacgtggggccgagggaaccctggtcaccgtcctcctcacgcctccaccaacggg

SEQ ID NO: 533234 - DNA, 507 bp, Homo sapiens; identical to SEQ ID NO: 450728
  misc_feature: HEFZJCU01D27X1.10.38.D05.1.454.heavy.3.raw

SEQ ID NO: 533235 - DNA, 541 bp, Homo sapiens
  misc_feature: HEFZJCU01BJN5E.16.87.H10.1.454.heavy.3.raw
tgtactactccacgaccggtgctcgatttagcagtactgcgttgggtttgggggcccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaacgggccgattcaccgtctccagagacaacaccaagaacacactatatctgcagattgacagtctgagacccgagggacacggctgtgtattactgtgcaaggcagttcgtaggaaaccagttagtgggttggggggtagtttggggttttttttcgttaacgtacgggtat

SEQ ID NO: 533236 - DNA, 533 bp, Homo sapiens
  misc_feature: HEFZJCU01BPB21.11.13.B02.1.454.heavy.3.raw
  modified_base (389)..(389): a, c, t, g, unknown or other
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattgggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcncctgtatccgaccgttggagtcagggaactcgtgtcaccgtctccctcagcctccaccaacgggcccaagtcggtcttccccctgggccgccctcgctccaggagacaccctccgacggagccacagccggcccgtgggccgtc

SEQ ID NO: 533237 - DNA, 409 bp, Homo sapiens
  misc_feature: HEFZJCU01A7XKO.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccaagggcagaatcacacttaccgcggacaaatccacgggcacagcgcagtgga

SEQ ID NO: 533238 - DNA, 533 bp, Homo sapiens
  misc_feature: HEFZJCU01CJYXJ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcgtggggccgagggggacccgtcggtcatcgtctccccagcctccaccaagggcccatcgtcttccccctggccgccctcg

SEQ ID NO: 533239 - DNA, 536 bp, Homo sapiens
  misc_feature: HEFZJCU01CJYV6.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctcaagtgattgatctgagaagtgaggacacggctgtttattactgtgcgcggtggctggacccgctcttgactacgtggggggccgggggagcccccgggtcatcgtccttcc

SEQ ID NO: 533240 - DNA, 503 bp, Homo sapiens
  misc_feature: HEFZJCU01AYHXI.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctgggaggtccctgagactctcctgtacagcctctggcttcaccttcattacctatggcatgcactgggtccgccagactccaggcagggggctggagtggggtggcaggttatttcatagtgatggaaatagtgacttctattcagactccgtggaagggccgattcaccgtctccagagacaattccaggcacacgctgtatctgcaaatgaacagcctgagagctgaggacacggctgtgtattactgtgcgaaagatttctatagaggtgacgtacgggggcgttc

SEQ ID NO: 533241 - DNA, 497 bp, Homo sapiens
  misc_feature: HEFZJCU01AXZ70.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctcagggaaggggctggagtgggtctcatccattagtagtaatagtgcctacagatactacgcagactcactgaagggcgactcacatctccagagacaacgccaagaactcactgtatctgcaaatgaacagcctgagagcgaggacacggctgtgtattactgtgcgagaggagctattatctcggaaccccgat

SEQ ID NO: 533242 - DNA, 503 bp, Homo sapiens
  misc_feature: HEFZJCU01AXLX1.11.57.F02.1.454.heavy.3.raw
  modified_base (237)..(237): a, c, t, g, unknown or other
cgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacgggtacgtgctgttgtactgctcctcccgnggctttgtcttggcattatgcacctccacgccgtccacgtaccagttgaacttgacctcagggtcttcgtggctcacgtccaccaccacgcatgtgacctcaggggtccgccaggctccaggtagggctggaatggatttcatacattagcagtagtggtgcgaccatatactacgcagactctgtgaagggccgattcatcatctccagagacaatggcaacaactcactgtatctggaaatcaacagcctggagagtcgaggac

SEQ ID NO: 533243 - DNA, 522 bp, Homo sapiens
  misc_feature: HEFZJCU01A04GK.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccgaggcgggaggttccaagtacttccg

SEQ ID NO: 533244 - DNA, 506 bp, Homo sapiens
  misc_feature: HEFZJCU01BR64Z.3.67.G01.1.454.heavy.3.raw
  modified_base (303)..(303): a, c, t, g, unknown or other
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccnccaggctccagggaaggggctggagtgggttggccatataaaaagtaagactgctggtgagacaacagactacgctgctgccttcagaggcagattcaccatcttcagagatgaatcaacagagcactctgtttctgcaaatgaacagcctggaagacgcggacacagccatgtatttattgtacagttaggactactatacg

SEQ ID NO: 533245 - DNA, 504 bp, Homo sapiens
  misc_feature: HEFZJCU01BZNRQ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgagcctacggcaggcggcctttgactttc

SEQ ID NO: 533246 - DNA, 506 bp, Homo sapiens
  misc_feature: HEFZJCU01ETC08.47.48.E04.1.454.heavy.3.raw
  modified_base (426)..(426): a, c, t, g, unknown or other
agctcacgtacacgaccggtgctcgatttagagagcgtcacagagagaaggggctcagagaggagccttagccctggactccaaggcctttccacttggtgatcagcactgagcacagaggatcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttcngcaaatggacagcccgagagtcgaagacacggctgtgtattactgtgtgtctctgacgcctcggccgactttggcttctc

SEQ ID NO: 533247 - DNA, 529 bp, Homo sapiens
  misc_feature: HEFZJCU01ERD3H.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctacaagagtcgagtcagcatgtcagtcgacacgtcccagaaccagttctccctgacagtgagttatatgaccgccgcagacacggccgtgtattactgtgcgagagaggtccgttattttaggaccagcttagttaaaacctccttaactacggtctggacgtcgtcggggccacggggacctaac

SEQ ID NO: 533248 - DNA, 539 bp, Homo sapiens
  misc_feature: HEFZJCU01DAYDQ.48.40.D07.1.454.heavy.3.raw
  modified_base (444)..(444): a, c, t, g, unknown or other
  modified_base (485)..(485): a, c, t, g, unknown or other
agtatacatacacgaccggtgctcgatttagtgatagagcgtaacaacagagggggagccccagacctgggattcccagctgtttctgcttgctgatcaggaccgcacacagagagctcaccatggagttgggggctgacctgggttttccttgtggctactttaagaggtgtcctgtgtgaggtgcacctgctggagtccgggggagggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaatacgcggactccgtgaaggccgcttcaccgtctccagagacaacggcgagaatactctgtatttgcagatgagaaatctagagaggngaggacaccgcgcttattatgtcaacgtcgttttacttttntaatggtgtctcttacgaacgacatgactattggggtacggggacccgtggtcc

SEQ ID NO: 533249 - DNA, 507 bp, Homo sapiens
  misc_feature: HEFZJCU01B8O9T.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaatagaaattgacaacgactgcttttgatatgttggggccaagggacctacg

SEQ ID NO: 533250 - DNA, 519 bp, Homo sapiens
  misc_feature: HEFZJCU01EEZAE.2.81.H04.1.454.heavy.3.raw
acgctcgacacacgaccggtgctcgatttagtagtgtagattcgcgggggctgccctttggctttggacgatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggctgtgtattattgtg

SEQ ID NO: 533251 - DNA, 503 bp, Homo sapiens; identical to SEQ ID NO: 445995
  misc_feature: HEFZJCU01AMSDQ.17.25.C03.1.454.heavy.3.raw

SEQ ID NO: 533252 - DNA, 509 bp, Homo sapiens
  misc_feature: HEFZJCU01EP4EC.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccaggaactctgtcaccgtctccgcagcctcaccaacggcc

SEQ ID NO: 533253 - DNA, 517 bp, Homo sapiens
  misc_feature: HEFZJCU01DZVAN.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgttcgtgggggccaaggggaccacggtcaccgtctccctcacgccctccaccaacgggcccatcc

SEQ ID NO: 533254 - DNA, 509 bp, Homo sapiens
  misc_feature: HEFZJCU01EZXJ3.11.57.F02.1.454.heavy.3.raw
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcagtagtggtgcgaccatatactacgcagactctgtgaagggccgattcatcatctccagagacaatggcaacaactcactgtactctaggaaatcaacagcctagagagtcgaggacacgg

SEQ ID NO: 533255 - DNA, 522 bp, Homo sapiens
  misc_feature: HEFZJCU01EVNL1.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggttcatacatttatcctagtggtgataccatatactacgcagactctgtgaagggccgattcaccatctccagggacaacgccaagaactcactgactttgacaatgaacaccctgcgagccgaggacacggccgtatacttactgtgcgagaataacccgttcgccttggttattaccg

SEQ ID NO: 533256 - DNA, 565 bp, Homo sapiens
  misc_feature: HEFZJCU01C1CTN.40.33.C11.1.454.heavy.3.raw
tctagcgactcacgaccggtgctcgatttagagtgagctcgttgggtttggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctcaccaagggcccatcggtcttcccctggcgccctgctccaggagcacctccgacgagcacagccggcccgtcgggctcggtccctcggttcgaagggaacctaccttttacccaggtcggtctaggaccttaggaggtccgggggaccgttgggccgaaacggggcggaccaattaacgg

SEQ ID NO: 533257 - DNA, 537 bp, Homo sapiens
  misc_feature: HEFZJCU01EZPEY.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactagtaacactagtctcctttttacacctcccttcgtacttcgtgggccagtacggaacccggtccg

SEQ ID NO: 533258 - DNA, 523 bp, Homo sapiens
  misc_feature: HEFZJCU01BTNOD.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcccggggacagacttaccatgacccacgaactcctccataaacacagcctacatggagttgaggagcctgacatctgacgacacggccgtctattactgtgcgagagtcccacgatccgggtgacgccgtacggcaggcgggcctttggacttcgtgggggacccaggggacgg

SEQ ID NO: 533259 - DNA, 508 bp, Homo sapiens
  misc_feature: HEFZJCU01BI40W.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcacttttatctgcaaatgaactagcctgagaaccgacgacacggccgtctattattgtgtcatagacctagatacaacgacggtggt

SEQ ID NO: 533260 - DNA, 523 bp, Homo sapiens
  misc_feature: HEFZJCU01E1LTZ.49.41.D08.1.454.heavy.3.raw
agtcgagagacacgaccggtgctcgatttagtcacgcgagaaagggaaaggggtctgggagacgagcccagcactggaagtcgccggtgtttccattcggtgatcatcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaattcatatgattcaagtattggatattacgcagagtccgtaaagggccgattcaccatctccagagacaattcgaagaacaccatgtatctggaactgagcagagtcacatctgaggacacggctatgtattactgtgtgaaagacttttaatgacagtagtggtttctccgtagtatgcacattac

SEQ ID NO: 533261 - DNA, 514 bp, Homo sapiens
  misc_feature: HEFZJCU01EBJEJ.49.42.D09.1.454.heavy.3.raw
  modified_base (456)..(456): a, c, t, g, unknown or other
agtcgagagacacgaccggtgctcgatttagacacatacgcagggaaaggggtctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactacaactacgcagactcactggagggccgattcaccatctccagagacaacaccaagaatttactgtatctgcaaatggacagcctgagagccgacgacncggctgtctattactgtgcgagagttcgggatattgccgtagtcccagatgtcccgaa

SEQ ID NO: 533262 - DNA, 525 bp, Homo sapiens
  misc_feature: HEFZJCU01DBST3.9.70.G04.1.454.heavy.3.raw
  modified_base (373)..(373): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacncgtcccagaaccagttctccctgacagtgagttatatgaccgccgcagacacggccgtgtattactgtgcgagagaggccgtttattttaggaccagctagttaaaaactcctactaccggtctggacgtcgtggggccaggggaccgaaac

SEQ ID NO: 533263 - DNA, 532 bp, Homo sapiens
  misc_feature: HEFZJCU01EGSDM.7.78.H01.1.454.heavy.3.raw
  modified_base (478)..(478): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggattnactactggggccagggaaccctggtcaccgtctcctcagcctccaccaaggccc

SEQ ID NO: 533264 - DNA, 519 bp, Homo sapiens
  misc_feature: HEFZJCU01DRUHN.48.60.F05.1.454.heavy.3.raw
agtatacatacacgaccggtgctcgatttagtacgtcatcagggaaagggggctctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatcctaccaaatagaaacagcctgaggacgaccgacgaccacggctgtgtattacgtgtcggcgagtacgttggggagaggaggtagggacctta

SEQ ID NO: 533265 - DNA, 531 bp, Homo sapiens
  misc_feature: HEFZJCU01DZBNR.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaacgggcccatcggtccttccccctcggccgccctcgcctccaggagcacctcgtgggggcacagcggcccgtcgggcgtggcctcgggtcaaggtactaaccttccctatacc

SEQ ID NO: 533266 - DNA, 505 bp, Homo sapiens
  misc_feature: HEFZJCU01B03SB.13.11.A11.1.454.heavy.3.raw
tcacgtactacacgaccggtgctcgatttagctacgactgcagggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggccgtggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcggaggacacggcctttgtatttctgtgcgaggttagcagtggctggtacttacgct

SEQ ID NO: 533267 - DNA, 531 bp, Homo sapiens
  misc_feature: HEFZJCU01D8EHD.13.39.D06.1.454.heavy.3.raw
tcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtctgggggaggcttggtacagcctggggggtccctgagactctcctgtgcagcctctggattcaccttcagtacctacgacatgcactgggtccgccaacctctaggaaaaggtccggagtgggtctcagggattggcagtgttggtgacacattctattcagactccgtgaagggccgattcaccatctccagagaaaatgccaacaactccttccatcttcaaatgaacagcctgagagacgggggacacggctgtgtattactgtgcaagagggggcaatttcttatttactacttcgacgtctcggggcaaaagggga

SEQ ID NO: 533268 - DNA, 309 bp, Homo sapiens
  misc_feature: HEFZJCU01AYYXL.48.20.B09.1.454.heavy.3.raw
agtatacatacacgaccggtgctcgatttagtgtagtgtgaagggccggttcaccatctacagagacaacggcaagaagtcgctgtttctgcaaatgaacagcctgacctccgacgacacggctctctattattgtgtgagagaatcctggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatact

SEQ ID NO: 533269 - DNA, 509 bp, Homo sapiens; identical to SEQ ID NO: 447939
  misc_feature: HEFZJCU01A8PSN.17.25.C03.1.454.heavy.3.raw

SEQ ID NO: 533270 - DNA, 510 bp, Homo sapiens
  misc_feature: HEFZJCU01B4ZH8.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtggtcagcgcttaccaagttggctacacaaattatgcacagaagttccaggacagagtcaccatgaccacagacacatccacgagcacagacctacatggaactgaggagcctgagatctgacgacacggccgtagtatttctgcgcgagagaacgtaaaggtagacgtggtagttccggggggacgacatgactacc

SEQ ID NO: 533271 - DNA, 518 bp, Homo sapiens
  misc_feature: HEFZJCU01BTGW3.51.77.G11.1.454.heavy.3.raw
cgatcgtatacacgaccggtgctcgatttagctagtcactcaagggaaaggggctgggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccagacaaggggctggaatggggtggcagttatttcgtccactggaaacagtaaaacattatggacgctccgtgaagggcccattcgccatctccagagacaattaccaaaaataccctctatctgcgaatgaacagcctagccgacctgaagacaacggctatataatttctggtgcgaggaggggagtctttattgtaatgatggtttcct

SEQ ID NO: 533272 - DNA, 535 bp, Homo sapiens
  misc_feature: HEFZJCU01A4S0Z.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgagtgaagacgcctgggtcctcggtgagggtctcctgcaagggcttctggaggcacccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctccctttcgacttctcgggcacgtcggaaccccggtaccg

SEQ ID NO: 533273 - DNA, 517 bp, Homo sapiens
  misc_feature: HEFZJCU01AYEXP.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggccaccctcctccaagagcacctcgtgggggcacagcggcccgtgggccttgccttggtctaaggacgtaacttccgagttagtaca

SEQ ID NO: 533274 - DNA, 517 bp, Homo sapiens
  misc_feature: HEFZJCU01EOI9Y.52.33.C11.1.454.heavy.3.raw
cgcagtacgacacgaccggtgctcgatttagagtgagctcgttgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccgagcgacaggtccgactaacacagcctacatggagctaagtagactagacatctgacgacacggccgtactattagttgtgtgagagaggacccgatcggacctcgaacatggacgtctgggg

SEQ ID NO: 533275 - DNA, 508 bp, Homo sapiens
  misc_feature: HEFZJCU01B3TK5.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtagaagggccggttcaccatctccagagacaattccaagaacacactgtatctgcaaatgaaacagcctgagagccgacgacacggccatatattactgtgcgaaagccgaccggcagttagtcacccatactactttgactacgt

SEQ ID NO: 533276 - DNA, 511 bp, Homo sapiens
  misc_feature: HEFZJCU01B304B.49.77.G11.1.454.heavy.3.raw
agtcgagagacacgaccggtgctcgatttagctagtcactcaagggaaaggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctggattcaccttcagtagctactggatggactgggtccgccaagctccagggaagggctggtgtgggtctcacgtattaatagtgatgggagtagaaaagctacgcggactccgtgaagggccgattctccatctccagagacaacgccaagaacacgctgtatctgcaatgaacagtctgagagccgaggaaacggctgtgtattactgtgcaggtatcgaccgcgacaacaaattcgagatacacg

SEQ ID NO: 533277 - DNA, 535 bp, Homo sapiens
  misc_feature: HEFZJCU01B6MGC.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttatttttgtacgagagcgtcgtctgtcagtggaattgactactgggccagggaaccctggtcaccgtctcctcagcctccaccaagggccc

SEQ ID NO: 533278 - DNA, 499 bp, Homo sapiens
  misc_feature: HEFZJCU01DF7B2.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccgtgaagggccgattcaccatctccagagacaattccaagaaccacggcagtatctgcaaatgaacagcctgagagcttgacggacacggctgtgtattactgtgggagagatgggaggtcgatattggt

SEQ ID NO: 533279 - DNA, 513 bp, Homo sapiens
  misc_feature: HEFZJCU01ET0AG.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcatgggggccac

SEQ ID NO: 533280 - DNA, 514 bp, Homo sapiens
  misc_feature: HEFZJCU01CXEH4.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctcgtgggccgtggcacctggtcactgtcttctcagcctccaccaacgggcccatcggtcttcccctggcaccctcctccaagacgcacctcgtgggggcacacgcggccctggctgcctggtcaaggactactccta

SEQ ID NO: 533281 - DNA, 518 bp, Homo sapiens
  misc_feature: HEFZJCU01CVN2D.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaatagaacagcctcgaaacgaggacacggcgtgtattactgtgccagacatcgtcgtattacgtatttttctagtggtcccg

SEQ ID NO: 533282 - DNA, 512 bp, Homo sapiens
  misc_feature: HEFZJCU01C0T74.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgaattcagagaactcacttttactctgcaaatgaacagcctgagaaccgacgacacggccgtctattattgttgtcatagaccgtaggatacaacgac

SEQ ID NO: 533283 - DNA, 501 bp, Homo sapiens
  misc_feature: HEFZJCU01CX04E.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggaggtaaaatatattatggagactccggtgaagggccgattcaccatctccagagacaattccaagaacacagtggatctgcaaatgaacagcctgagagcgtgggggacacggctgtgtattactgtgcgagagcggctggcaactacatccatttac

SEQ ID NO: 533284 - DNA, 399 bp, Homo sapiens
  misc_feature: HEFZJCU01DPSP2.47.62.F07.1.454.heavy.3.raw
agctcacgtacacgaccggtgctcgatttagtagtcgcataaagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctagtgagct

SEQ ID NO: 533285 - DNA, 492 bp, Homo sapiens
  misc_feature: HEFZJCU01B95Z2.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttcctcgttgctattttagaaggtgtccggtgtgaggtgcagctggtggagtcggggggaggcttgggtacagcctggggggtccctgagactctcctgtgtagcgtctggattcacattcagtagttatagcatgaactgggtccgcaggctccagggaaggggctggagtgggtttcatatattgatagaaatagtggaaccatatacgtatgcagactctgtgaggggccgattcaccatctccagagacaatgccaggaattcactgatgtggaaatgaacagtctgagagccgaggacacgggctctctattactgtgcg

SEQ ID NO: 533286 - DNA, 502 bp, Homo sapiens
  misc_feature: HEFZJCU01B370Q.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggcgccagggaagcctggtcaccgtctcctcagcctccaccaagggcccatcggtcttcccctggcgccctgctccaggagcaccctccgagagcacagcggccctggggcctgcctggtcaggactacttcctacgtcgtat

SEQ ID NO: 533287 - DNA, 540 bp, Homo sapiens
  misc_feature: HEFZJCU01AJJIF.49.26.C04.1.454.heavy.3.raw
agtcgagagacacgaccggtgctcgatttagtctagcgactttgggtttgggggagtctccttcaccacccagctgggatctcagggcttccttttctgtcctcctccaggatggggtcaaccgccatcctcgccctcctcctggctgttctccaaggggtctgtgccgaggtgcaactggtgcagtccggagcagaagtgaaaagcccgggggagtctctgaggatctcctgtaagatttctggagacaccttaaccacctattggatcagctgggtgcgccagatgcccggtaaaggcctggaatggatggggatgattgatcccagtgactcttttaccacgtacggtcccgtccttccaatggcacgtcaccatctcagctgacaagtcccaaaggagtgcctccctggagtggaccagcctgagggcctccggacacccgccatgtattactgtgcaagtgggggtcgggggagcagtgtctggcattattactactactctgtgtacgtctgggcggagggactcggtctaccg

SEQ ID NO: 533288 - DNA, 502 bp, Homo sapiens
  misc_feature: HEFZJCU01CXHXF.47.48.E04.1.454.heavy.3.raw
  modified_base (469)..(469): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctgggagtgggttggcaacataaatccagatggaagtcagaaaacctatgtggactctctgaagggccgattcaccatctccagagacaacgccaagaactctctgtttctgcaaatggacagcctgagagtcaagcaggctgtgtattacngtgtgtctctgacgcctggccggaccttgcttc

SEQ ID NO: 533289 - DNA, 491 bp, Homo sapiens
  misc_feature: HEFZJCU01BX2L3.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctgactttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcattgaacagcctgagagccgaggacacggccgtatattactgtgcgaagatttggggaatgaccacgtc

SEQ ID NO: 533290 - DNA, 512 bp, Homo sapiens
  misc_feature: HEFZJCU01A3A8Z.9.12.B01.1.454.heavy.3.raw
  modified_base (480)..(480): a, c, t, g, unknown or other
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaactctcctgtgcagcctctggatacaccgtcagtagtaactccatgaactgggtccgccaggctccagggaaggggctggagtgggtctcgagtttatttatagcgggtggtaaccacatactacgcagacctccggtgaaggggcaggattcaccatctccagagacaacttccaggaacacgctgtatcttcaatgaacagcctgagagtcgaggacacggctgtatattactgtagngagagatgtgtacgtcttttgatatcgtgggg

SEQ ID NO: 533291 - DNA, 521 bp, Homo sapiens
  misc_feature: HEFZJCU01BFWTZ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggccaccctcctccaagagcacctctgggggcacagcggccctgggctgcctggtcgaaggactacttcctagagacacg

SEQ ID NO: 533292 - DNA, 483 bp, Homo sapiens; identical to SEQ ID NO: 444639
  misc_feature: HEFZJCU01ERDLX.11.23.C01.1.454.heavy.3.raw

SEQ ID NO: 533293 - DNA, 523 bp, Homo sapiens
  misc_feature: HEFZJCU01CYSUG.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgtggtcgactgtcgacctggactggtacttcgattctgtggggcgtggcacctc

SEQ ID NO: 533294 - DNA, 513 bp, Homo sapiens
  misc_feature: HEFZJCU01BRCYU.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaacaggcggagtccaagtactctttg

SEQ ID NO: 533295 - DNA, 524 bp, Homo sapiens; identical to SEQ ID NO: 446401
  misc_feature: HEFZJCU01ETRUV.3.82.H05.1.454.heavy.3.raw

SEQ ID NO: 533296 - DNA, 530 bp, Homo sapiens
  misc_feature: HEFZJCU01ATQSB.16.27.C05.1.454.heavy.3.raw
  modified_base (521)..(521): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttattcatatgatggaactactcaacactatccagactccggggagggccgattcaccgtctccagagacaattccaagaacagggtgtttctccaagtgattgatctgagaagtgaggacacggctgttattactgtgcggcggtggctgaccgctcttgactacgtgggggccgggggagccccgggtnacgtcgtct

SEQ ID NO: 533297 - DNA, 562 bp, Homo sapiens
  misc_feature: HEFZJCU01AM0T6.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctatttttaaaaggtgtccagtgtgaggtgcagctgttggagtctgggggaggcttggcacagcctggggggtccctgagactctcctgtgcagcctctggattcacctttgacagctatgccatcgacctgggtccgccaggctccagggaagggctggaatgggtctcaggtattactggtggtggtttataccacagtacttaccggcacggacctccggttgaaacggggtcccgggtttccaaccctaattccttacccagacggaccaaactttcccgaaaggaaacacccaacttggtaatccgtgcaaatacgaacagcctagagacgccgaacgaccaaccggccatatattactgtgacgaaagccgaccggcagttaggtccacccacgttacttaacgttt

SEQ ID NO: 533298 - DNA, 506 bp, Homo sapiens
  misc_feature: HEFZJCU01B5CPW.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacaacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 533299 - DNA, 478 bp, Homo sapiens
  misc_feature: HEFZJCU01BTYSC.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatatttcatgtccaacacgtggaatacaaattatgcaccatctgttgagagtcgactgacaatcaacgtagacacatcgaagaaccagttctccctgcagctgacctctgtgactcccgaggacacggtgtatattactgtggaagacggccccat

SEQ ID NO: 533300 - DNA, 501 bp, Homo sapiens
  misc_feature: HEFZJCU01CZIKA.11.71.G05.1.454.heavy.3.raw
  modified_base (481)..(481): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagacgacaattccaggcacacgctgtatctgcaaatgaacagcctgagagctgaggacacggctgtagtattactgtgacgaaagntttactatagaggtgactac

SEQ ID NO: 533301 - DNA, 514 bp, Homo sapiens
  misc_feature: HEFZJCU01CRAOY.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaacgggcccatcggtcttcccctggcaccctcctccaagagcacctctgggggcacagcggcccgtgggctcgcctggtcaaggactacttccgtactacg

SEQ ID NO: 533302 - DNA, 489 bp, Homo sapiens
  misc_feature: HEFZJCU01BZ8GB.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacgtacgggtgtatattactgtaggtaagaggcccccataacg

SEQ ID NO: 533303 - DNA, 517 bp, Homo sapiens
  misc_feature: HEFZJCU01DBJWT.3.82.H05.1.454.heavy.3.raw
  modified_base (511)..(511): a, c, t, g, unknown or other
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcacctgttctacttcgntctctc

SEQ ID NO: 533304 - DNA, 505 bp, Homo sapiens
  misc_feature: HEFZJCU01A3CI5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgatacggccgtctattactgtgcgagacgtcccacgatccggtgagcctacggcagcggcctttgacttcgtc

SEQ ID NO: 533305 - DNA, 502 bp, Homo sapiens
  misc_feature: HEFZJCU01CXNQK.12.25.C03.1.454.heavy.3.raw
  modified_base (398)..(398): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccgagggcagactcaccatgaccacagacacatcagcgaacanagtcaacatggagttgcggagcctgcgatctgacgacgcggccgtatattactgtgcgagagtacgtgcggctgtcctttgactactggggctgggaactctgg

SEQ ID NO: 533306 - DNA, 556 bp, Homo sapiens
  misc_feature: HEFZJCU01A029T.16.27.C05.1.454.heavy.3.raw
tgtactactccacgaccggtgctcgatttagacgcgatcgaagggtttggggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaactactatccagactccggggagggccgattccaccgtctccagagacaattccaagaacagggtgtttctccaagtgattgatctgagaagtgaggacacgggctgtttattactgtgcgtcgggtggctggaccgctcgtttgacttacgtcggggggtccgggggaggcccccgggttcacgttccggttcctcccg

SEQ ID NO: 533307 - DNA, 509 bp, Homo sapiens
  misc_feature: HEFZJCU01CMUFS.48.34.D01.1.454.heavy.3.raw
agtatacatacacgaccggtgctcgatttagatcgtctgtgttggggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggccgccctgctccaggagcacctccgagacgcacagccggccctcggggcctcgcctcggtcaaggacctacgttcctatgtatact

SEQ ID NO: 533308 - DNA, 533 bp, Homo sapiens
  misc_feature: HEFZJCU01BZCC0.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagccctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactcccctgaaagcgcaactactactactacggtatggacctcgtc

SEQ ID NO: 533309 - DNA, 492 bp, Homo sapiens
  misc_feature: HEFZJCU01BOLBB.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagacctacggcacagaaattccaggacagagtcacgattaccgcggacgaatccacgaccacagcctacatagagctgcgcagcctgagatctacgaagacacggccaatttattactgtgcgagagatgcagggccctcccactatccggtttta

SEQ ID NO: 533310 - DNA, 526 bp, Homo sapiens
  misc_feature: HEFZJCU01DEMGE.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgcaggctccagggaagggctggagtgggtggccaatatacagtcaggtggaggtacgatacactatctcgactctgtgaagggccggttcaccatctccagagacaacgccaagaattcactgtatctgcaaatgaacagcctgagagtcggaaagacacgggtatttattattgtgtgcgagatctggatttccttcgaaatgaagtgtggttcgatgtggtttgattcg

SEQ ID NO: 533311 - DNA, 534 bp, Homo sapiens
  misc_feature: HEFZJCU01EOPXK.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtggggttggccgttctagagacacaactaacagtgacaccgcacaatacgccgcgtctgtgaaaggcagattcaccatctcaagagatgattcagagaactcactttatactgcaaatgaacagcctagagaaccgacgaacacgggcccgtctattattgtgtctatagaaccctagggtatacaaacggacggttggtaaccgtggtattc

SEQ ID NO: 533312 - DNA, 519 bp, Homo sapiens
  misc_feature: HEFZJCU01EE1X3.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggtttttcctcgttgctcttttaagaggtgtccagtgtcaagtgcaactggtggagtctgggggaggcgtggtccagcctggggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagctaagtcctgagacacgggtgtatactactgtacgaggaggggggaaccagcgggagttccaagtactcctttgacgtcgtc

SEQ ID NO: 533313 - DNA, 517 bp, Homo sapiens
  misc_feature: HEFZJCU01E1XY2.48.12.B01.1.454.heavy.3.raw
agtatacatacacgaccggtgctcgatttagtagtgtagattccgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggactgagcggcctgagaccgtgaggacacgggccatttactactgtgcgcgggggaggtggacggagcgttcggtttcggtagttatctatctactactttgtaacg

SEQ ID NO: 533314 - DNA, 492 bp, Homo sapiens
  misc_feature: HEFZJCU01CD5IB.11.26.C04.1.454.heavy.3.raw
  modified_base (231)..(231): a, c, t, g, unknown or other
cgagagataccacgaccggtgctcgatttagtctagcgactttgggtttggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttnaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcccgtgggcttgcctggtcaaggactacttccgtatctctcg

SEQ ID NO: 533315 - DNA, 497 bp, Homo sapiens
  misc_feature: HEFZJCU01D1710.49.38.D05.1.454.heavy.3.raw
agtcgagagacacgaccggtgctcgatttagtatctgatagttgggtttggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtattatttctgtgcgagagagatgttctttctatgatagtactagtctatt

SEQ ID NO: 533316 - DNA, 525 bp, Homo sapiens
  misc_feature: HEFZJCU01B8YK9.12.40.D07.1.454.heavy.3.raw
atacgacgtacacgaccggtgctcgatttagtgatagagcgtaacaacagaggactcaccgatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcacgtgggtccgccaggctccaggcaaggggctcgagtgggtggcacttattgcacatgatggcgtcaacaaattctacgcaaattccgtgaggggccgattcaccatctccagagacaattacaagaacaccctttatcctgcaaatagacagcctgagaccagacgacacggctgtctattacttgcgcgagagagacacacgaacctactggccaatactatgggggcttggttctggggccaggggaccctggtcatcgtctccccagcctccacaagggcccatcggtcttcccctggcg

SEQ ID NO: 533317 - DNA, 507 bp, Homo sapiens
  misc_feature: HEFZJCU01BGYBC.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggtcactacatattattctgactccgtgaagggccggttcaccctctccagagacacttccaacaacatcttgtatcttcacatgcacaatctgagagtcgacgacacggccaacctattattgtgcgcgacagtgaactcgctcaattctggggccagggacg

SEQ ID NO: 533318 - DNA, 540 bp, Homo sapiens
  misc_feature: HEFZJCU01BOFTX.16.87.H10.1.454.heavy.3.raw
  modified_base (483)..(483): a, c, t, g, unknown or other
tgtactactccacgaccggtgctcgatttagcagtactgcgttgggtttggggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccgagggaaggggctggtgtgggtctcacatattaatctcgatgggagtaatttagcctacgcggactccgtcaagggccgattcaccgtctccagagacaacaccaagaacacactatatctgcagattgacagtctgacgacccggaggacacggctgtgtattactgtgcaaggcagttcgnggaaactagttagtgggttggggggagtttggggttttttttacgttacgtacgggt

SEQ ID NO: 533319 - DNA, 499 bp, Homo sapiens; identical to SEQ ID NO: 452982
  misc_feature: HEFZJCU01CAM8G.11.71.G05.1.454.heavy.3.raw

SEQ ID NO: 533320 - DNA, 482 bp, Homo sapiens
  misc_feature: HEFZJCU01EL293.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttccccctggcgccctgctccaggagcacctccgagagcacagcggccctggctgcctggtcaaggactacttccactactatg

SEQ ID NO: 533321 - DNA, 538 bp, Homo sapiens
  misc_feature: HEFZJCU01BTP9I.13.88.H11.1.454.heavy.3.raw
tcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccttggtgtttttttaaaaggtgtccactgtgagctgcagctggtggagtctggggggggcttggtaaagcctggggggtcccttacactctcctgtgtagcctctaaatcactttcaacgacgcctggatgagctgggtccgccaggcgccagggaggggactggagtgggttggccgtattaaaagcgaggccgatggtgggacagcagacttcgctgcacccgtgcaagccagattcaccctctccaagacatgatttagagaatactgtgtatttgcaaatgaacagcttgacaaccgaggacgcaggcgtttatactgtgccagtagttccacctgccacctctacttctttgacttctggggccagggaaccctc

SEQ ID NO: 533322 - DNA, 504 bp, Homo sapiens
  misc_feature: HEFZJCU01ENTNQ.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattacacagaagttacgagggcagagtcaccattaccagggacacatccgcgaacacagcctacatcggagctgagcagcctgacatctgaagacacggctggtgtattactgttcgaggcgggactagtcgtgggatcgtagttatagtgtactcgtcgttcgt

SEQ ID NO: 533323 - DNA, 499 bp, Homo sapiens
  misc_feature: HEFZJCU01CP30C.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctactgacgacatggccatgtattactgtaggaagacgtacgttggtggcgtaccgcggggtctacggacc

SEQ ID NO: 533324 - DNA, 503 bp, Homo sapiens
  misc_feature: HEFZJCU01BFT65.10.28.C06.1.454.heavy.3.raw
  modified_base (449)..(449): a, c, t, g, unknown or other
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaatgaacagtctgagngccgaggacacggctctctattactgtgcgagacgacccaaagtaggtactacg

SEQ ID NO: 533325 - DNA, 520 bp, Homo sapiens
  misc_feature: HEFZJCU01D9IUR.10.85.H08.1.454.heavy.3.raw
catagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccaataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaacggccacg

SEQ ID NO: 533326 - DNA, 536 bp, Homo sapiens
  misc_feature: HEFZJCU01D6P6L.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagacgacaattccaagaacagggtgtttctccaagtgattgatctgagaagtgaggacaggcttagtttattactgtgcgcggtggctgaccgcttcttgacttacgtgggggccgggggtagccccgggtcagtcgtctt

SEQ ID NO: 533327 - DNA, 527 bp, Homo sapiens; identical to SEQ ID NO: 455909
  misc_feature: HEFZJCU01APSB0.11.25.C03.1.454.heavy.3.raw

SEQ ID NO: 533328 - DNA, 521 bp, Homo sapiens
  misc_feature: HEFZJCU01BSJNQ.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactccgtcttgagatcgtggggccaggggtacaagtggtcaccgtctctt

SEQ ID NO: 533329 - DNA, 519 bp, Homo sapiens
  misc_feature: HEFZJCU01AGYY8.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctcggcaccctcctccaagagcacctctgggggcacagcggcctgggctgcctggtcaaggactacttcctagagacacg

SEQ ID NO: 533330 - DNA, 556 bp, Homo sapiens
  misc_feature: HEFZJCU01EN585.18.33.C11.1.454.heavy.3.raw
tacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcattttacgttgtaccccgtggggggccccggggggaaaccccttgggtaccacccggtcctcccccgacccctccccaaaccc

SEQ ID NO: 533331 - DNA, 551 bp, Homo sapiens
  misc_feature: HEFZJCU01AZE4R.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctggtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgagctgagctctgtgaccgccgcgacacggccgtgtatttctgtgcgagatctttcgatttttggagttcggtaacccccttggctactggggtcccgaggggaaccctggttcaccggttcctcttcacggccctcccaacccgaaggggcccctacg

SEQ ID NO: 533332 - DNA, 523 bp, Homo sapiens
  misc_feature: HEFZJCU01B2M56.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatattattactgtgcgacgaaggacggttttggggcgcggactcctcttgagatcgtgggccgaggggacaagtggtacacgtctctcag

SEQ ID NO: 533333 - DNA, 530 bp, Homo sapiens
  misc_feature: HEFZJCU01EDV8R.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatcgtcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccggggaacctggtcaccgtctccccaccctccaccg

SEQ ID NO: 533334 - DNA, 512 bp, Homo sapiens
  misc_feature: HEFZJCU01CNWCT.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatggagagtaagcactacagtccgtctctgaagaacaggctcaccatcaccaaggacacctccacaaaccaggtggtccttacaatgaccaatatggaccctgtggacacagccacatattactgttcacgctctatgggttcggggagtttattagtcccttactttgacttacgtggggccagggaactcgtggtcaccgtctccgcagcctccacc

SEQ ID NO: 533335 - DNA, 518 bp, Homo sapiens
  misc_feature: HEFZJCU01AQH3O.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaattgaacagcctgagagccgatgacacggccgtgtattactgtgcgtagagatgggggcccacgaacgttactacgctatggacgtcgtggggaccg

SEQ ID NO: 533336 - DNA, 522 bp, Homo sapiens
  misc_feature: HEFZJCU01D3T2D.13.39.D06.1.454.heavy.3.raw
  modified_base (446)..(446): a, c, t, g, unknown or other
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggcctttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacnggtggacgtcgtggggccgaaagggaccacgggtcaccgtccgtcctcacgcctaccaccaacggggtcccagtcc

SEQ ID NO: 533337 - DNA, 533 bp, Homo sapiens
  misc_feature: HEFZJCU01D0G08.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaaagcacgctgtatctgcaaatgaacagcctgacgaaccgaggacacagccgtgtagttactgtaccacactcccctagaaacgcgtacaactactactactacggtatggacctcgt

SEQ ID NO: 533338 - DNA, 556 bp, Homo sapiens
  misc_feature: HEFZJCU01CHNRW.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctcacaaaccaggtggtccttacaatgaccaatatggaccctgtggacacagccacatattactgttcacgcttctatggttcgggggagttattacgtcccttactttcggacttacgttgggggcccaggggtaaaccttcgttcgggttctaacccggtccttcccggctaaggcccttcccaacccgtaaacgggggcccc

SEQ ID NO: 533339 - DNA, 539 bp, Homo sapiens
  misc_feature: HEFZJCU01DXT25.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtgggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgcttcctttttactacccttcccttgtacttcgtcgggccagtcggaaccccggtccg

SEQ ID NO: 533340 - DNA, 522 bp, Homo sapiens
  misc_feature: HEFZJCU01DK3KE.9.70.G04.1.454.heavy.3.raw
tgatacgtctcacgaccggtgctcgatttagtgtagtgtgaagggaaagggcctggtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttagttttacggaccagctgttaaaaactcctactacggtctggacgtctgggccaggggacctaac

SEQ ID NO: 533341 - DNA, 514 bp, Homo sapiens
  misc_feature: HEFZJCU01BXKJ6.51.81.H04.1.454.heavy.3.raw
cgatcgtatacacgaccggtgctcgatttagtagtgtagattcgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtcgtattactgtgcgacagagcggcggacagtaggtcgtcttactcggttcgaggctcctccccctacg

SEQ ID NO: 533342 - DNA, 400 bp, Homo sapiens; identical to SEQ ID NO: 444452
  misc_feature: HEFZJCU01DM37F.47.24.C02.1.454.heavy.3.raw

SEQ ID NO: 533343 - DNA, 352 bp, Homo sapiens; identical to SEQ ID NO: 445546
  misc_feature: HEFZJCU01BYPQN.10.38.D05.1.454.heavy.3.raw

SEQ ID NO: 533344 - DNA, 533 bp, Homo sapiens
  misc_feature: HEFZJCU01D4PUS.7.70.G04.1.454.heavy.3.raw
  modified_base (348)..(348): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagngtcgagtaacgatctcagtggacacgtctaaacaatcacctctccctgaggctgagctctgtgacagccgcggacacgggcgtttattactgtgcgagaggggacggactacgggtgactacgtgggggttccgaccccgttggggccaggggaaccctgggtccaccggtcctccgtcacgccc

SEQ ID NO: 533345 - DNA, 532 bp, Homo sapiens
  misc_feature: HEFZJCU01CUPFX.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaacagttatgggttggggggtagttggggttttttttcgttacttacgggt

SEQ ID NO: 533346 - DNA, 506 bp, Homo sapiens
  misc_feature: HEFZJCU01ASDQ3.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaaggcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgacggacacggctgtgtattactgtgcgagaggagctattatctacggaaccccgatgt

SEQ ID NO: 533347 - DNA, 507 bp, Homo sapiens
  misc_feature: HEFZJCU01D0A3O.11.71.G05.1.454.heavy.3.raw
cgagagataccacgaccggtgctcgatttagtgtcgtcgcaagagagagggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccagggcacacgctgtatctgcaaatgaacagcctgagagccgatgacacggccgtgtattactgtgcgagagagtcggggcccacgaacgttactacgt

SEQ ID NO: 533348 - DNA, 505 bp, Homo sapiens
  misc_feature: HEFZJCU01DC313.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaaggcccatcggtcttcccctggcaccctcctccaagagcacctctgggggcacagcggccctgggctgcctggtcaggactacttcctactcgtt

SEQ ID NO: 533349 - DNA, 542 bp, Homo sapiens
  misc_feature: HEFZJCU01DREVT.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctgggccgaagggaccacggtcaccgtctcctcagcctccaccaaggcccatcggtcttcccctggccaccctcctccaagagcacctctcggggggcacacgcggcccgtgggcctcgccgtggt

SEQ ID NO: 533350 - DNA, 505 bp, Homo sapiens
  misc_feature: HEFZJCU01CX625.51.12.B01.1.454.heavy.3.raw
cgatcgtatacacgaccggtgctcgattagtagtgtagattccgcgggggcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgtacacggccgtctattactgtgcgacgagaagcggcggacagaggttcgcttactggttcgaggctctcccc
